United States Patent
Janusz et al.

(10) Patent No.: US 12,059,441 B2
(45) Date of Patent: Aug. 13, 2024

(54) PROBIOTIC BACTERIAL STRAINS THAT PRODUCE SHORT CHAIN FATTY ACIDS AND COMPOSITIONS COMPRISING SAME

(71) Applicant: International N&H Denmark ApS, Cincinnati (DK)

(72) Inventors: Michael John Janusz, Oregonia, OH (US); Anna Malgorzata Plechaty, Springboro, OH (US)

(73) Assignee: INTERNATIONAL N&H DENMARK APS, Kongens Lyngby (DK)

( * ) Notice: Subject to any disclaimer, the term of this patent is extended or adjusted under 35 U.S.C. 154(b) by 340 days.

(21) Appl. No.: 16/860,377

(22) Filed: Apr. 28, 2020

(65) Prior Publication Data

US 2020/0345791 A1    Nov. 5, 2020

Related U.S. Application Data

(60) Provisional application No. 62/841,385, filed on May 1, 2019.

(51) Int. Cl.
| | |
|---|---|
| *A61K 35/741* | (2015.01) |
| *C12N 1/20* | (2006.01) |
| *C12P 7/6409* | (2022.01) |

(52) U.S. Cl.
CPC .............. *A61K 35/741* (2013.01); *C12N 1/20* (2013.01); *C12P 7/6409* (2013.01)

(58) Field of Classification Search
CPC .......... A61K 35/741; C12N 1/20; C12N 1/04; C12P 7/6409; C12P 7/52; C12P 7/54; A23L 33/135; A61P 1/00
See application file for complete search history.

(56) References Cited

U.S. PATENT DOCUMENTS

| | | | |
|---|---|---|---|
| 9,314,489 B2 | 4/2016 | Kelly | |
| 9,486,487 B2 | 11/2016 | Cutcliffe | |

FOREIGN PATENT DOCUMENTS

| | | |
|---|---|---|
| CN | 106497791 A | 3/2017 |
| WO | 0207741 A1 | 1/2002 |

(Continued)

OTHER PUBLICATIONS

Takada T, Watanabe K, Makino H, Kushiro A. Reclassification of Eubacterium desmolans as Butyricicoccus desmolans comb. nov., and description of Butyricicoccus faecihominis sp. nov., a butyrate-producing bacterium from human faeces. Int J Syst Evol Microbiol. Oct. 2016;66(10):4125-4131. doi: 10.1099/ijsem.0.001323.*

(Continued)

*Primary Examiner* — Kade Ariani

(57) ABSTRACT

Disclosed herein are probiotic bacterial strains or species that produce short chain fatty acids (SCFA), such as butyrate, and compositions comprising the same. The bacterial strains or compositions prepared thereby are used in preparing food, supplements, compositions, and other consumables to provide health benefits, including therapeutic applications, for a variety of disorders, including metabolic, immune, intestinal, and inflammatory disorders. Thus, also disclosed herein are methods of treating a subject suffering from a disorder, such as a metabolic disorder, an immune disorder, an intestinal disorder, or an inflammatory disorder with a composition comprising the probiotic bacterial strains or species disclosed herein. Uses of a bacterial strain or species and a composition comprising them provided in a nutritional product or medicament to improve health or prevent or treat a variety of disorders in a subject are also disclosed.

20 Claims, 15 Drawing Sheets

Specification includes a Sequence Listing.

(56) References Cited

FOREIGN PATENT DOCUMENTS

| WO | WO-2010124855 A1 * | 11/2010 | ............ A23K 20/10 |
|---|---|---|---|
| WO | WO2016070151 A1 | 5/2016 | |
| WO | WO2016185469 A1 | 11/2016 | |
| WO | 2017160711 A1 | 9/2017 | |
| WO | 2018081550 A1 | 5/2018 | |
| WO | WO2018234645 A1 | 12/2018 | |
| WO | WO2020056298 A1 | 3/2020 | |

OTHER PUBLICATIONS

Sharp R, Macfarlane GT. Chemostat enrichments of human feces with resistant starch are selective for adherent butyrate-producing clostridia at high dilution rates. Appl Environ Microbiol. Oct. 2000;66(10):4212-21. doi: 10.1128/AEM.66.10.4212-4221.2000. PMID: 11010862; PMCID: PMC92288.*

Konstantinidis KT, Ramette A, Tiedje JM. The bacterial species definition in the genomic era. Philos Trans R Soc Lond B Biol Sci. Nov. 29, 2006;361(1475):1929-40. doi: 10.1098/rstb.2006.1920. PMID: 17062412; PMCID: PMC1764935.*

Score, Sequence search results for Seq ID No. 13 in GenCore, 7 pages of PDF.*

Kailasapathy, K., Curr. Issues Intest. Microbiol., 2002, vol. 3, p. 39-48. (Year: 2002).*

Hijova E, Chmelarova A. Short chain fatty acids and colonic health. Bratisl Lek Listy. 2007;108(8):354-8. PMID: 18203540. (Year: 2007).*

UnlockFood.Ca, 2016, 5 pages of pdf. (Year: 2016).*

WO 2016178493 A1, English Translation 15 pages of PDF. (Year: 2016).*

BLAST search for Seq ID No. 7, GenBank EF533982.1, 2 pages of PDF conducted on Nov. 6, 2023. (Year: 2023).*

PCT Search Report and Written Opinion for PCT/US2020/030175 dated Jul. 24, 2020.

Anaerostipes caccae Schwiertz et al., Anaerostipes caccae DSM 14662, Data sheet from DSMZ—German Collection of Microorganisms and Cell Cultures GmbH, URL: https://www.dsmz.de/collection/catalogue/details/culture/DSM-14662, retrieved on Nov. 22, 2022, pp. 4.

Roseburia intestinalis Duncan et al., Roseburia intestinalis DSM 14610, Data sheet from DSMZ—German Colelction of Microorganisms and Cell Cultures GmbH, URL: https://www.dsmz.de/collection/catalogue/details/culture/ DSM-14610, retrieved on Nov. 22, 2022, pp. 4.

Baxter, Nielson T. et al. "Dynamics of Human Gut Microbiota and Short-Chain Fatty Acids in Response to Dietary Interventions with Three Fermentable Fibers", MBIO, vol. 10, No. 1, Jan. 1, 2019, pp. e02566-18.

Bircher, Lea et al. "Effect of cryopreservation and lyophilization on viability and growth of strict anaerobic human gut microbes", Microbial Biotechnology, vol. 11, No. 4, Jul. 1, 2018, pp. 721-733.

Janusz, Michael et al: "Exploiting Mechanism of Action to Develop Next Generation Probiotics", Apr. 1, 2019 Retrieved from the Internet: URL:https://4cau4jsalerlzglkq3wnmjel-wpengine.netdna-ssl.com/wp-content/uploads/2019/04/Janusz-Abstract.pdf; retrieve on Jul. 9, 2020.

Ouwerkerk, D.: "EM_STD:AF316590", Feb. 12, 2001, retrieved from the internet: URL:http://ibis.internal.epo.org/exam/dbfetch.jsp?id-EM_STD:AF316590.

Riviere, Audrey et al: "Bifidobacteria and Butyrate-Producing Colon Bacteria: Importance and Strategies for Their Stimulation in the Human Cut", Frontiers in Microbiology, vol. 7, Jun. 28, 2016.

Zhao Jiajun et al. "Systematic Endocrinology", Popular Science Press, No Known Date, 59 pages.

Third Party Observation for 20730140.9 dated Sep. 15, 2023, 7 pages.

Vital et al., "Revealing the Bacterial Butyrate Synthesis Pathways by Analyzing (Meta)genomic Data", vol. 5, Issue No. 2, Mar./Apr. 2014, 11 pages.

* cited by examiner

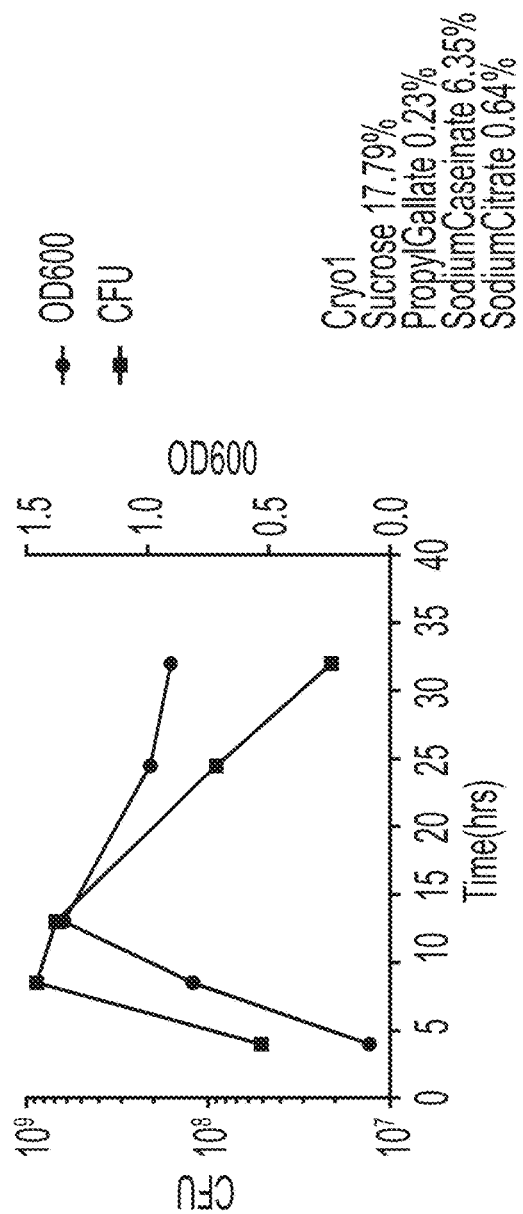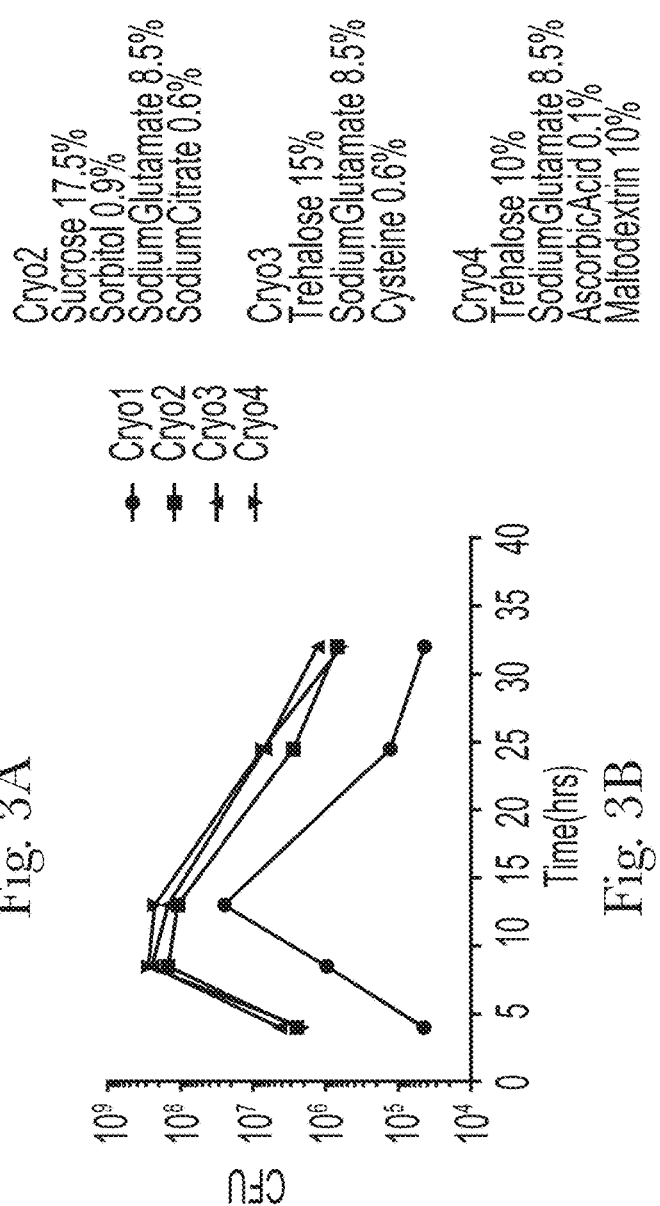
Fig. 3A
Fig. 3B

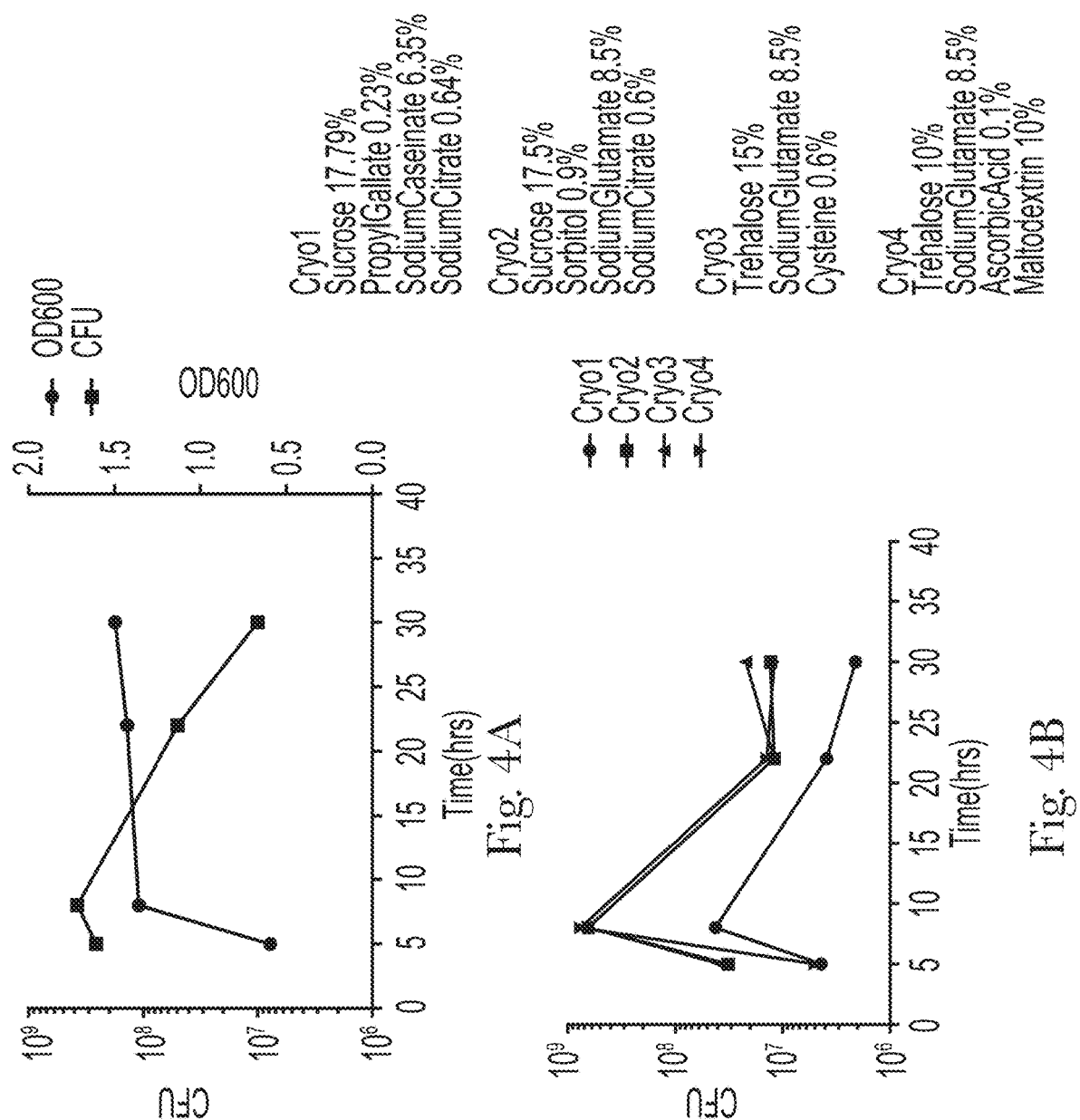

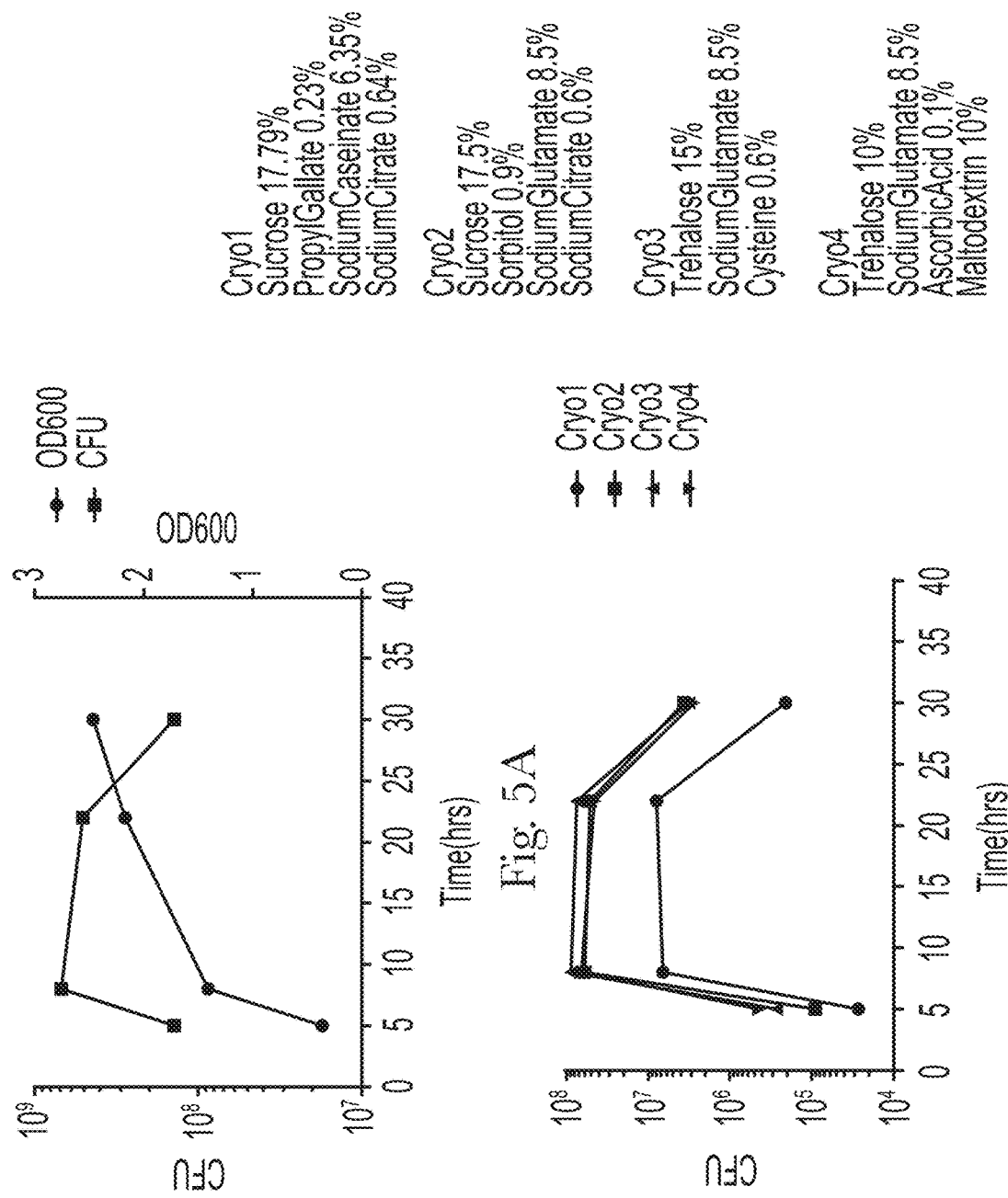

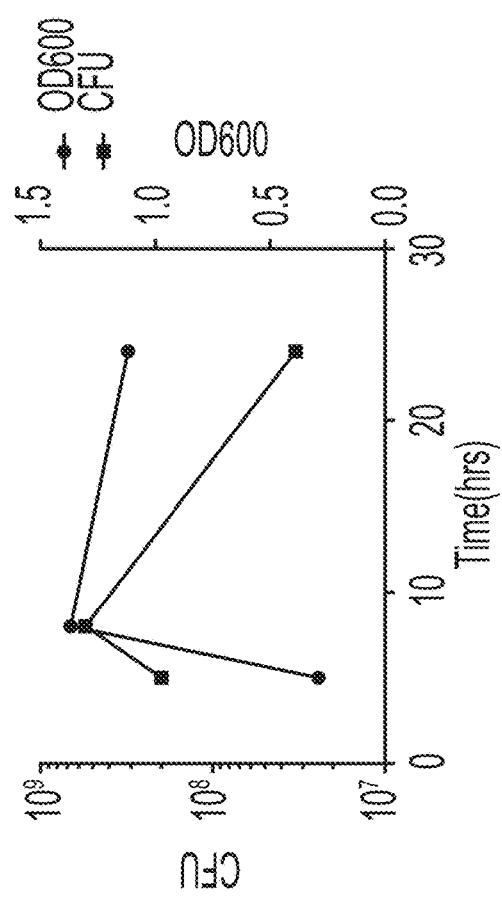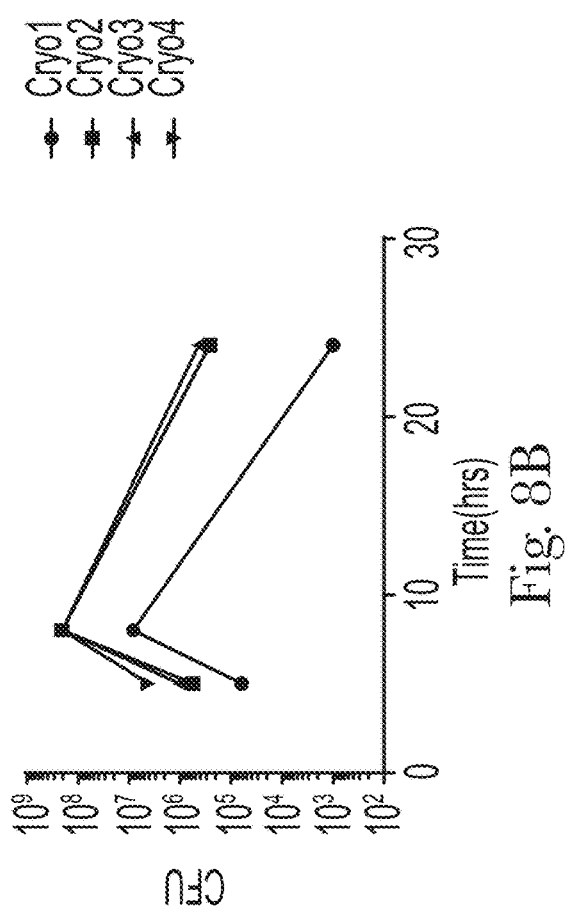

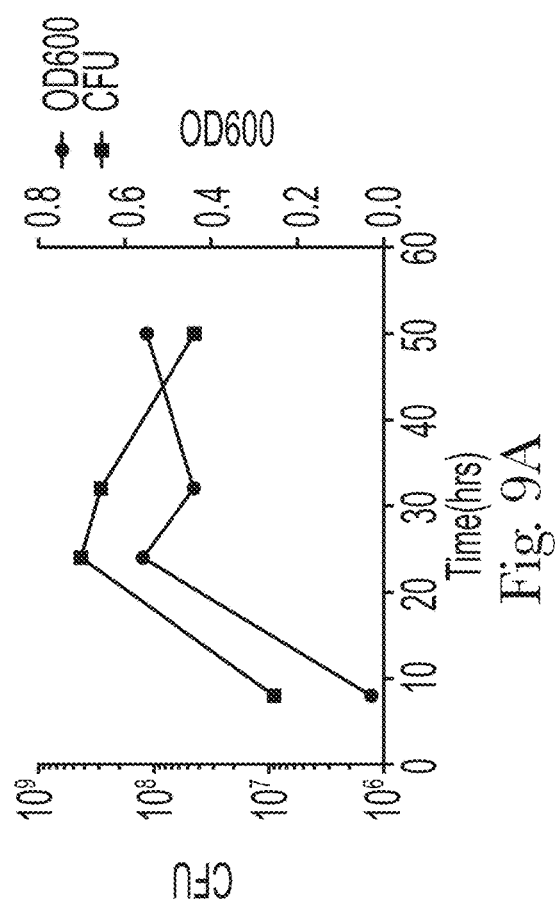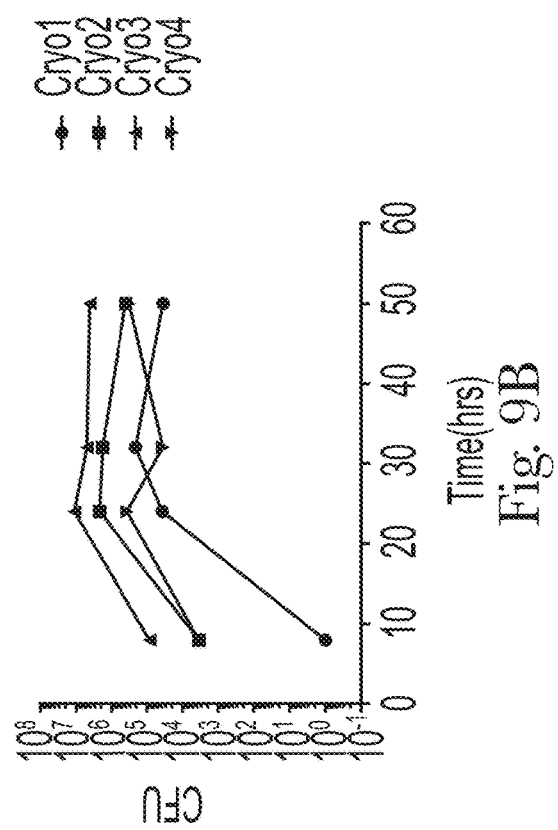

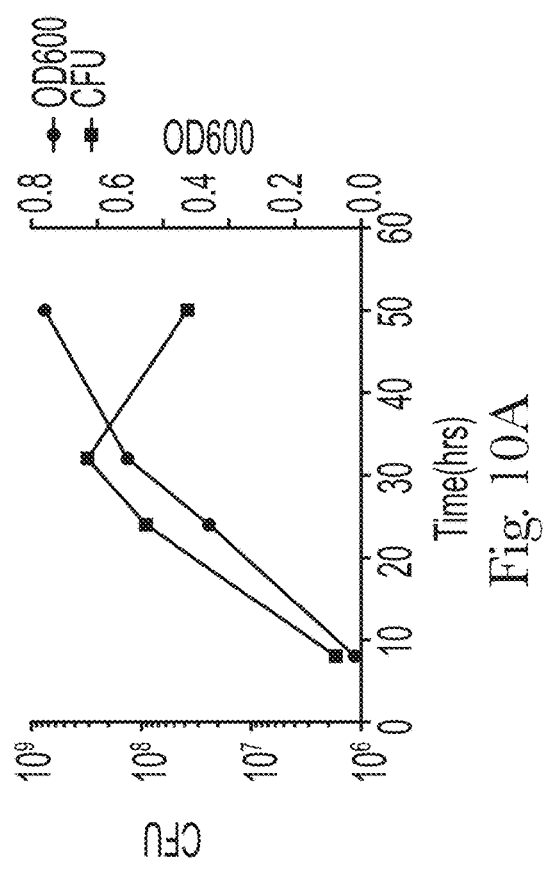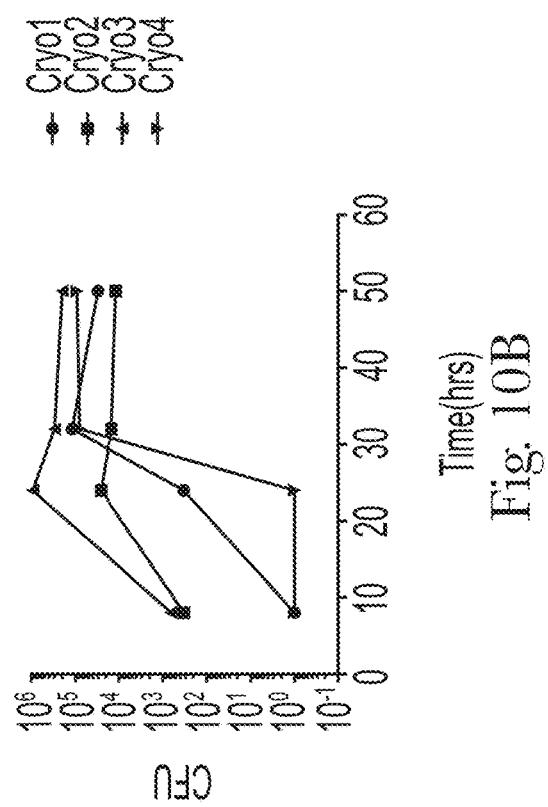
Fig. 10A
Fig. 10B

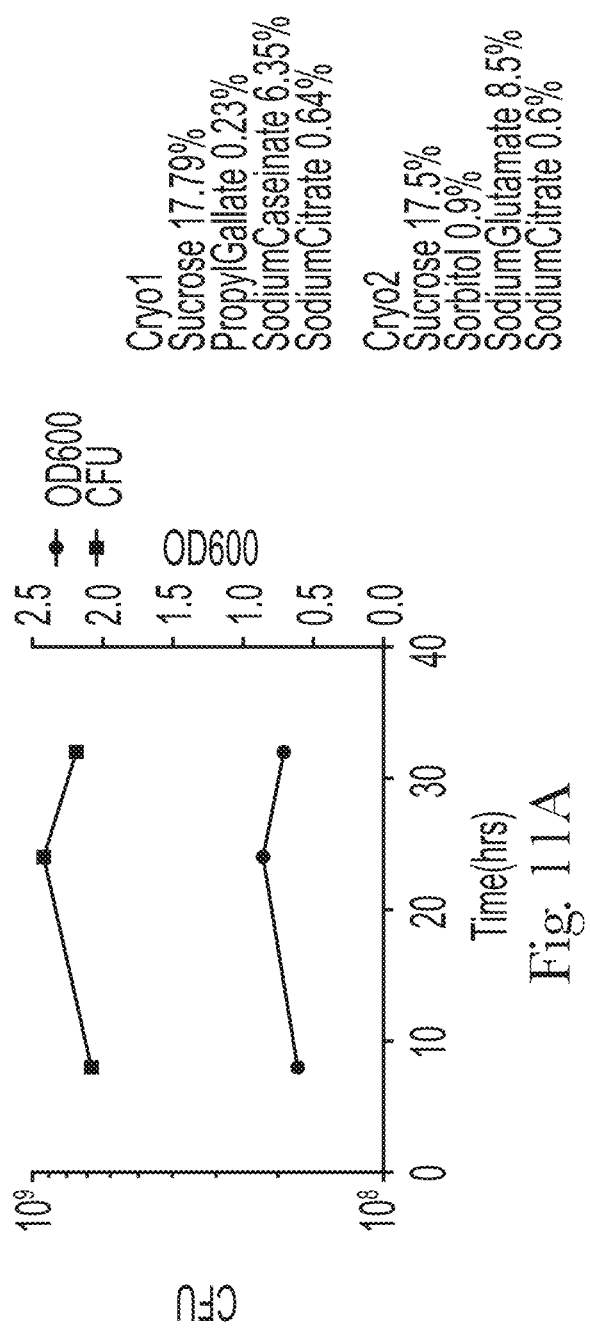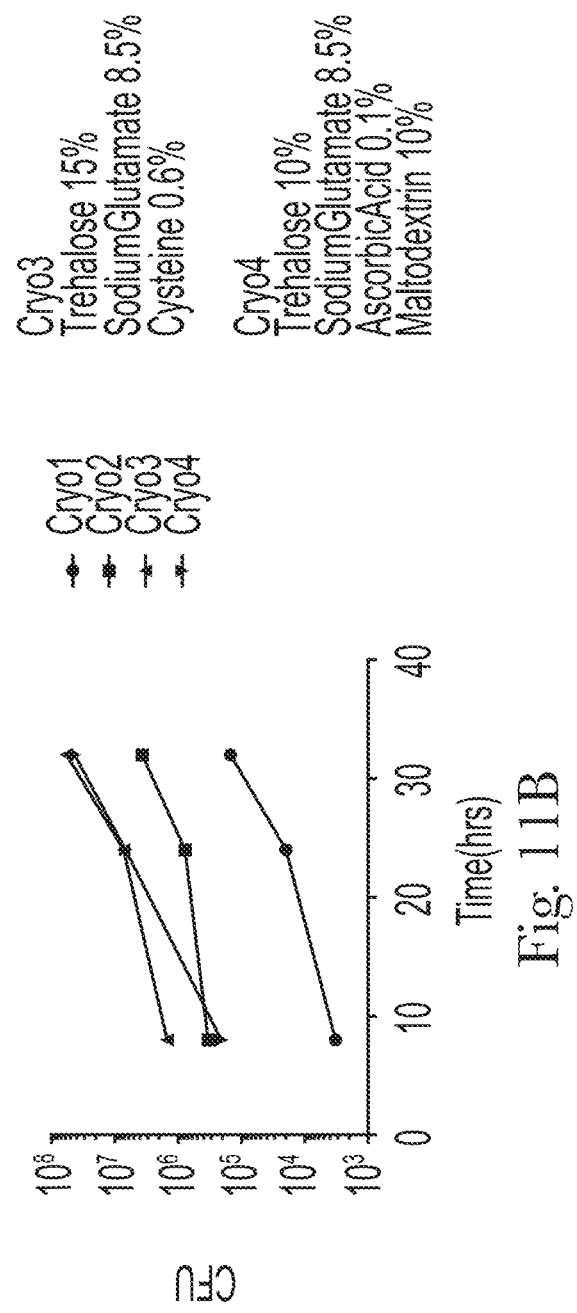
Fig. 11A
Fig. 11B

| Isolate | RCB | TSB | YCFA+RS | PYG | GM-17 | BHI | MTGE |
|---|---|---|---|---|---|---|---|
| Clostridium butyricum YC2-268.2 | ++++ | ++++ | +++++ | +++++ | ++++ | +++ | + |
| Clostridium butyricum YC2-242.3 | ++++ | +++ | +++++ | +++++ | ++++ | ++ | + |
| Clostridium cochlearium YC1-202 | NIZO?? | | | | | | |
| Agathobacter rectalis RC2-6 | +++ | + | +++ | + | + | + | + |
| Agathobacter rectalis YC1-37 | ++++ | +++ | ++++ | +++++ | ++++ | +++ | + |
| Butyricicoccus faecihomonis ODS-26 | ++++ | + | No growth | ++++ | + | + | + |
| Butyricicoccus faecihomonis RC1-135.2 | +++++ | ++ | No growth | +++++ | + | ++ | + |
| Clostridium innocuum M17MSO.2-9 | ++++ | ++ | + | +++ | +++ | +++ | ++ |
| Clostridium Innocuum RC1-219 | ++++ | ++ | No growth | +++ | +++ | +++ | ++ |
| Coprococcus comes RC1-148 | ++++ | ++ | + | +++ | +++ | +++ | ++ |
| Coprococcus comes VDS-14 | +++ | ++ | + | ++++ | ++ | +++ | ++ |
| Roseburia faecis RC1-143 | +++ | No growth | +++++ | +++ | ++ | ++ | ++ |
| Roseburia faecis RC1-78 | +++ | ++ | +++++ | +++ | ++ | + | + |
| anaerostipes hadrus RC2-95 | +++++ | +++ | No growth | +++++ | +++ | +++ | ++ |
| Anaerostipes hadrus FLM9MS-5.1 | +++++ | +++ | No growth | +++++ | ++++ | +++ | +++ |
| Roseburia intestinalis ODS-29 | ++ | + | +++ | + | ++ | + | + |
| Roseburia intestinalis RC1-32 | +++ | No growth | No growth | No growth | No growth | + | No growth |
| Anaerostipes caccae FLM9MS-25 | +++ | + | + | ++++ | ++ | ++ | + |
| Flavonifactor plautii FLM9MS-20 | + | + | + | + | + | + | + |
| Roseburia inulinivorans YC-156 | +++ | No growth | + | + | No growth | + | + |
| Roseburia hominis RC1-32 | +++ | No growth | No growth | No growth | No growth | + | No growth |

Fig. 13

| Isolate | Peak CFU | Time of Peak CFU (Hr) | | | | Log Reduction at Peak CFU (Time 0) | | | | Log Reduction at Peak CFU (Time 30d)[1] | | | |
|---|---|---|---|---|---|---|---|---|---|---|---|---|---|
| | | Cryo 1 | Cryo 2 | Cryo 3 | Cryo 4 | Cryo 1 | Cryo 2 | Cryo 3 | Cryo 4 | Cryo 1 | Cryo 2 | Cryo 3 | Cryo 4 |
| Roseburia faecis RC1-78 | $9.0 \times 10^8$ | 13 | 8.5 | 8.5 | 8.5 | 1.54 | .49 | .77 | .77 | 4.31 | 2.41 | 2.41 | 2.06 |
| Coprococcus comes RC1-148 | $4.0 \times 10^8$ | 8 | 8 | 8 | 8 | 1.96 | .77 | .77 | .77 | 2.54 | .945 | .945 | 1.23 |
| Anaerostipes hadrus FLM9MS-5.1 | $9.0 \times 10^8$ | 8 | 8 | 8 | 8 | 2.01 | 1.02 | .89 | .89 | 2.61 | 2.76 | 2.76 | 2.46 |
| Agathobacter rectalis RC2-6 | $2.0 \times 10^9$ | 22 | 22 | 22 | 22 | 1.48 | .47 | 0.5 | 0.5 | 2.34 | 2.97 | 2.97 | 2.24 |
| Anaerostipes caccae FLM9MS-25 | $4.3 \times 10^8$ | 8 | 8 | 8 | 8 | 1.8 | 0.40 | 0.40 | 0.40 | 2.9 | 0.70 | 0.70 | 1.7 |
| Butyricicoccus faecihominis ODS-26 | $8.0 \times 10^7$ | 8 | 8 | 8 | 8 | 1.92 | 1.10 | 0.89 | 0.89 | 3.49 | 3.05 | 3.05 | 3.07 |
| Roseburia inulinivorans YC1-156 | $6.0 \times 10^6$ | 24 | 24 | 24 | 24 | 3.4 | 4.3 | 3.0 | 3.0 | 5.7 | 2.5 | 2.5 | 3.6 |
| Roseburia intestinalis ODS-29 | $5.0 \times 10^8$ | 32 | 32 | 32 | 32 | 3.70 | 2.31 | 1.11 | 1.11 | 3.32 | 3.5 | 3.5 | 3.53 |
| Flavonifactor plautii FLM9MS-20 | $3.0 \times 10^8$ | 24 | 24 | 24 | 24 | 2.03 | .90 | .70 | .70 | 2.26 | 1.26 | 1.26 | .95 |
| Roseburia hominis RC1-32 | $4.3 \times 10^8$ | 32 | 32 | 32 | 32 | 4.1 | 2.3 | 1.6 | 1.6 | 5.6 | 6.2 | 6.2 | 4.3 |

[1] 30 day stability was done in sealed glass cryo vials in the anaerobic chamber (RT high humidity)

Fig. 14

| Isolate | $O_2$ Sens[1] | Microoxic growth plates[2] |
|---|---|---|
| Clostridium butyricum YC2-268.2 | 60 min | Yes |
| Agathobacter rectalis RC2-6 | 2 min | Few Colonies |
| Butyricicoccus faerihomonis ODS-26 | 5 min | No |
| Clostridium innocuum M17MSO 2.9 | 60 min | Yes |
| Coprococcus comes RC1-148 | 5 min | No |
| Roseburia faecis RC1-78 | 5 min | No |
| Anaerostipes hadrus FLM9MS-5.1 | 5 min | No |
| Roeburia intestinalis ODS-29 | 2 min | No |
| Anaerostipes caccae FLM9MS-25 | 30 min | Yes |
| Flavonifactor plautii FLM9MS-20 | 30 min | No |
| Roseburia inulinivorans YC-156 | 5 min | Few Colonies |
| Roseburia hominis RC1-32 | 2 min | No |

Fig. 15

PROBIOTIC BACTERIAL STRAINS THAT PRODUCE SHORT CHAIN FATTY ACIDS AND COMPOSITIONS COMPRISING SAME

FIELD

The disclosure relates to probiotic bacterial strains or species that produce short chain fatty acids (SCFA), such as butyrate, for their delivery to the colon where SCFA are produced endogenously at their site of action providing health benefits for a variety of disorders, including metabolic, immune, intestinal, and inflammatory disorders, as well as compositions comprising such bacterial strains or species. In certain embodiments, the bacterial strains or compositions are used in preparing food, supplements, and other consumables to provide health benefits, including therapeutic applications, for a variety of disorders, including metabolic, immune, intestinal, and inflammatory disorders.

INCORPORATION BY REFERENCE OF THE SEQUENCE LISTING

This application contains, as a separate part of disclosure, a Sequence Listing in computer-readable form (Filename: 53257_Seqlisting.txt; Size: 60,978,131 bytes; Created: Apr. 24, 2019) which is incorporated by reference herein in its entirety.

BACKGROUND

Obesity and its associated cardiometabolic disorders are a major health care problem and the importance of the gut microbiota and its relationship with cardiometabolic disorders is increasingly being recognized. Increased consumption of dietary fiber has been associated with reduced appetite and weight loss. The gut microbiota ferments non-absorbable dietary fiber and produces short chain fatty acids (SCFA) that are important for intestinal health and metabolic functions (Canfora et al., Nature Reviews Endocrinology 11:577-91, 2015). The health benefits of SCFA, especially butyrate, include maintenance of the gut epithelial barrier by being an energy source for the colonocytes (Ping et al., J. Nutr. 139:1619-25, 2009; Suzuki et al., Br. J. Nutr. 100:297-305, 2008), pathogen inhibition by lowering the local pH (Rios-Covian et al., Frontiers Microbiology 7:1-9, 2016), and increasing mucus production (Jung et al., Nutr. Res. Pract. 9:343-9, 2015). In addition, SCFA have been shown to have anti-inflammatory activity in vitro and in vivo by increasing the number and function of anti-inflammatory T regulatory cells (Smith et al., Science 341:569-73, 2013).

SCFA have been shown to stimulate the production of the enteroendocrine peptides glucagon-like peptide 1 (GLP-1) and peptide YY (PYY), which increase satiety, stimulate the pancreas to secrete insulin, increase energy expenditure and increase central appetite regulation resulting in potential metabolic benefits (Canfora (supra); Yadav et al., J. Biol. Chem. 288:25088-97, 2013; Gao et al., Diabetes 58:1509-17, 2009; Frost et al., Nat. Commun. 5:3611, 2014; Line et al., PLoS ONE 4:e35240, 2012). The obese phenotype and insulin resistance can be transferred by the fecal flora from obese to lean mice (Turnbaugh et al., Nature 444:1027-31, 2006). In humans, a fecal transplant from a lean donor to subjects with metabolic syndrome improves insulin sensitivity and has been associated with an increase in butyrate producing bacteria (Vrieze et al., Gastroenterology 143:913-6, 2012; Kootte et al., Cell Metab. 26:611-9, 2017).

Butyrate levels vary widely among individuals and can be increased by consumption of fermentable fiber (McOrist et al., J. Nutr. 141:883-9, 2011). There are also oral butyrate supplements on the market but, because of the rancid smell of butyrate, the requirement of multiple capsules to deliver an effective dose and its rapid absorption in the upper gastrointestinal tract, this approach is undesirable (Pituch et al., Przeglad Gastroenterologiczny 8:295-8, 2013). Administration of probiotic bacterial strains that produce SCFAs results in the delivery of the butyrate producing organisms to the colon where SCFAs can be produced endogenously at their site of action providing health benefits for a variety of metabolic and immune disorders including, but not limited to, healthy glucose control and weight management.

SUMMARY

The disclosure provides novel probiotic bacterial strains that produce short chain fatty acids (SCFA) that are important for intestinal health and metabolic functions. The disclosure includes a composition comprising at least one human isolate of SCFA-producing bacteria or mixtures thereof, wherein the bacteria comprises a 16S ribosomal RNA (16S-rRNA) encoding gene sequence that is at least about 80% identical to any one of the nucleotide sequences of SEQ ID NOs: 1-23 or a DNA sequence that is at least about 80% identical to any one of the nucleotide sequences of SEQ ID NOs: 24-35, and an excipient, carrier, and/or diluent. In some aspects, the bacteria is selected from the group consisting of *Agathobacter rectalis*, *Anaerostipes caccae*, *Anaerostipes hadrus*, *Butyricicoccus faecihominis*, *Clostridium butyricum*, *Clostridium cochlearium*, *Clostridium innocuum*, *Coprococcus comes*, *Flavonifactor plautii*, *Roseburia faecis*, *Roseburia hominis*, *Roseburia intestinalis*, and *Roseburia inulinivorans*. In some aspects, the bacteria is lyophilized. In some aspects, the excipient is a cryoprotectant. In some aspects, the cryoprotectant comprises a sugar or a sugar alcohol. In some aspects, the cryoprotectant further comprises any one or more of propyl gallate, sodium caseinate, sodium citrate, sodium glutamate, cysteine, ascorbic acid, and/or maltodextrin.

In some aspects, the cryoprotectant comprises sucrose at about 1% to about 25%; trehalose at about 1% to about 25%; sorbitol at about 0.1% to about 5%; propyl gallate at about 0.05% to about 1.0%; sodium caseinate at about 0.5% to about 10%; sodium citrate at about 0.1% to about 5%; sodium glutamate at about 1% to about 15%; cysteine at about 0.01% to about 2.0%; ascorbic acid at about 0.005% to about 5.0%; maltodextrin at about 1% to about 20%; or a combination of any of any one or more of the components as set out above.

In some aspects, the cryoprotectant comprises sucrose at about 15% to about 20%, propyl gallate at about 0.05% to about 1.0%, sodium caseinate at about 4% to about 8%, and sodium citrate at about 0.2% to about 1.0%; sucrose at about 15% to about 20%, sorbitol at about 0.5% to about 1.5%, sodium glutamate at about 5% to about 12%, and sodium citrate at about 0.1% to about 1.5%; trehalose at about 5% to about 20%, sodium glutamate at about 3% to about 15%, cysteine at about 0.01% to about 1.0%; or trehalose at about 5% to about 20%, sodium glutamate at about 3% to about 15%, ascorbic acid at about 0.01% to about 2%, and maltodextrin at about 2% to about 18%.

In some aspects, the cryoprotectant comprises sucrose at about 17.8%, propyl gallate at about 0.2%, sodium caseinate at about 6.4%, and sodium citrate at about 0.6%; sucrose at about 17.5%, sorbitol at about 0.9%, sodium glutamate at about 8.5%, and sodium citrate at about 0.6%; trehalose at about 15%, sodium glutamate at about 8.5%, and cysteine at about 0.1%; or trehalose at about 10%, sodium glutamate at about 8.5%, ascorbic acid at about 0.2%, and maltodextrin at about 10%.

In some aspects, the composition comprises from about 1×E3 to about 1×E11 colony-forming units (CFU) of the SCFA-producing bacteria and mixtures thereof. In some aspects, the bacteria and/or mixtures thereof produce at least about 1000 micromoles of the SCFA over about 24 hours. In some aspects, the SCFA is acetate, propionate, or butyrate, or a combination thereof. In some aspects, the SCFA is butyrate.

In some aspects, the bacteria in the composition survive with less than about a 1 log unit reduction in CFU, less than about a 2 log reduction in CFU, less than about a 3 log reduction in CFU, less than about a 4 log reduction in CFU, less than about a 5 log reduction in CFU, or less than about a 6 log reduction in CFU of viable bacteria over about 12 months after lyophilization in the cryoprotectant.

In some aspects, the composition further comprises a prebiotic and/or a resistant starch.

In some aspects, the composition further comprises at least one additional bacteria that degrades resistant starch. Such additional bacteria include, but are not limited to, *Bifidobacterium adolescentis*, *Ruminococcus bromii*, *Bacteriodes thetaiotamicron*, *Bacteriodes ovatus*, *Bifidobacterium breve*, or *Roseburia intestinalis*.

In some aspects, a composition of the disclosure is a probiotic composition.

The disclosure also provides methods of increasing SCFA in the gastrointestinal tract of a subject comprising administering to the subject an effective amount of any of the compositions disclosed herein. In some aspects, the SCFA is acetate, propionate, or butyrate, or a combination thereof. In some aspects, the SCFA is butyrate. In some aspects, the subject suffers from or is at risk of suffering from a disorder. In some aspects, the disorder is an intestinal disorder, a metabolic disorder, an inflammatory disorder, or an immune disorder. In some aspects, the disorder is insulin resistance, insulin sensitivity, pre-diabetes, diabetes or Type 2 Diabetes Mellitus (T2DM), irritable bowel syndrome, metabolism irregularity, obesity, obesity-related conditions, hypertension, stress, stress-related conditions, drug metabolism irregularity, gastrointestinal infection, Inflammatory Bowel Disease (IBD), or Crohn's Disease.

The disclosure also provides methods for reducing or maintaining glucose level and/or body weight in a subject in need thereof comprising administering to the subject an effective amount of any of the compositions disclosed herein. In some aspects, the subject suffers from diabetes or pre-diabetes.

The disclosure further provides methods for treating, ameliorating, or preventing a disorder in a subject suffering therefrom or at risk of suffering therefrom comprising administering to the subject an effective amount of any of the compositions disclosed herein. In some aspects, the disorder is an intestinal disorder, a metabolic disorder, an inflammatory disorder, or an immune disorder. In some aspects, the disorder is insulin resistance, insulin sensitivity, pre-diabetes, diabetes or T2DM, irritable bowel syndrome, metabolism irregularity, obesity, obesity-related conditions, hypertension, stress, stress-related conditions, drug metabolism, gastrointestinal infection, IBD, or Crohn's Disease.

The disclosure provides uses of a composition as disclosed herein in treating a metabolic disorder, an immune disorder, an intestinal disorder, or an inflammatory disorder, or in the preparation of a medicament or nutritional product for treating a metabolic disorder, an immune disorder, an intestinal disorder, or an inflammatory disorder.

Other features and advantages of the disclosure will become apparent from the following detailed description. It should be understood, however, that the detailed description and the specific examples, while indicating embodiments of the disclosed subject matter, are given by way of illustration only, because various changes and modifications within the spirit and scope of the disclosure will become apparent to those skilled in the art from this detailed description.

BRIEF DESCRIPTION OF THE DRAWING

A more complete understanding of the compositions, methods, and uses disclosed herein can be obtained by reference to the accompanying drawings. These figures are merely schematic representations based on convenience and ease of demonstrating the disclosure, and are, therefore, not intended to define or limit the scope of the exemplary embodiments.

FIGS. 3A-B show the growth curve and post-lyophilization survival for *Roseburia faecis* (RC1-78; i.e., SEQ ID NO: 1). FIG. 3A shows growth curves pre-lyophilization. FIG. 3B shows post-lyophilization survival in four cryoprotectants for each of the pre-lyophilization growth times from FIG. 3A.

FIG. 4A-B show the growth curve and post-lyophilization survival for *Coprococcus comes* (RC1-148, i.e., SEQ ID NO: 10). FIG. 4A shows growth curves pre-lyophilization. FIG. 4B shows post-lyophilization survival in four cryoprotectants for each of the pre-lyophilization growth times from FIG. 4A.

FIG. 5A-B show the growth curve and post-lyophilization survival for *Anaerostipes hadrus* (MS-5.1, i.e., SEQ ID NO: 9). FIG. 5A shows growth curves pre-lyophilization. FIG. 5B shows post-lyophilization survival in four cryoprotectants for each of the pre-lyophilization growth times from FIG. 5A.

FIG. 6A shows growth curves pre-lyophilization. FIG. 6B shows post-lyophilization survival in four cryoprotectants for each of the pre-lyophilization growth times from FIG. 6A.

FIG. 7A shows growth curves pre-lyophilization. FIG. 7B shows post-lyophilization survival in four cryoprotectants for each of the pre-lyophilization growth times from FIG. 7A.

FIG. 8A-B show the growth curve and post-lyophilization survival for *Anaerostipes caccae* (FLM9MS-25, i.e., SEQ ID NO: 15). FIG. 8A shows growth curves pre-lyophilization. FIG. 8B shows post-lyophilization survival in four cryoprotectants for each of the pre-lyophilization growth times from FIG. 8A.

FIG. 9A-B show the growth curve and post-lyophilization survival for *Roseburia hominis* (RC1-32, i.e., SEQ ID NO: 21). FIG. 9A shows growth curves pre-lyophilization. FIG. 9B shows post-lyophilization survival in four cryoprotectants for each of the pre-lyophilization growth times from FIG. 9A.

FIG. 10A-B show the growth curve and post-lyophilization survival for *Roseburia inulinivorans* (YC1-156, i.e., SEQ ID NO: 22). FIG. 10A shows growth curves pre-lyophilization. FIG. 10B shows post-lyophilization survival in four cryoprotectants for each of the pre-lyophilization growth times from FIG. 10A.

FIG. 11A-B show the growth curve and post-lyophilization survival for *Roseburia intestinalis* (ODS-29, i.e., SEQ ID NO: 2). FIG. 11A shows growth curves pre-lyophilization. FIG. 11B shows post-lyophilization survival in four cryoprotectants for each of the pre-lyophilization growth times from FIG. 11A.

FIG. 12A shows growth curves pre-lyophilization. FIG. 12B shows post-lyophilization survival in four cryoprotectants for each of the pre-lyophilization growth times from FIG. 12A.

FIG. 13 shows comparisons of bacterial growth under static conditions in various types of media (1 mL) known in the art (e.g., RCB, TSB, YCFA+RS, PYG, GM-17, BHI, and MTGE) in a deep well plate in the anaerobic chamber at 37° C. (+++++=OD600 of >2; ++++=OD of 1.5-2; +++=OD of 1-1.5; ++=OD of 0.5-1; and +=OD of 0-0.5 at peak) This data shows which media allow the best growth at small scale.

FIG. 14 shows time of peak CFU production during growth phase and bacterial survival for cells harvested at peak CFU after lyophilization using 10 different bacteria in four different cryoprotectants immediately after lyophilization and 30 days after lyophilization.

FIG. 15 shows oxygen sensitivity of various bacterial isolates. For O$_2$Sens[1], bacteria were spotted with a 1:100 dilution of a strain on an RCA plate in an anaerobic chamber, then removed to the air, and then put back into the anaerobic chamber at various time points. Data is expressed as the longest exposure that resulted in visible growth on plates. For Microoxic growth plates[2], plates were spotted with a 1:100 dilution of a strain on an RCA plate in an anoxic chamber (set at 0 oxygen without the oxygen scavenger in the chamber), which kept the oxygen levels at between about 40-160 ppm. Growth was measured by visualization of colonies after about 32 hours.

DETAILED DESCRIPTION

Figure 1:
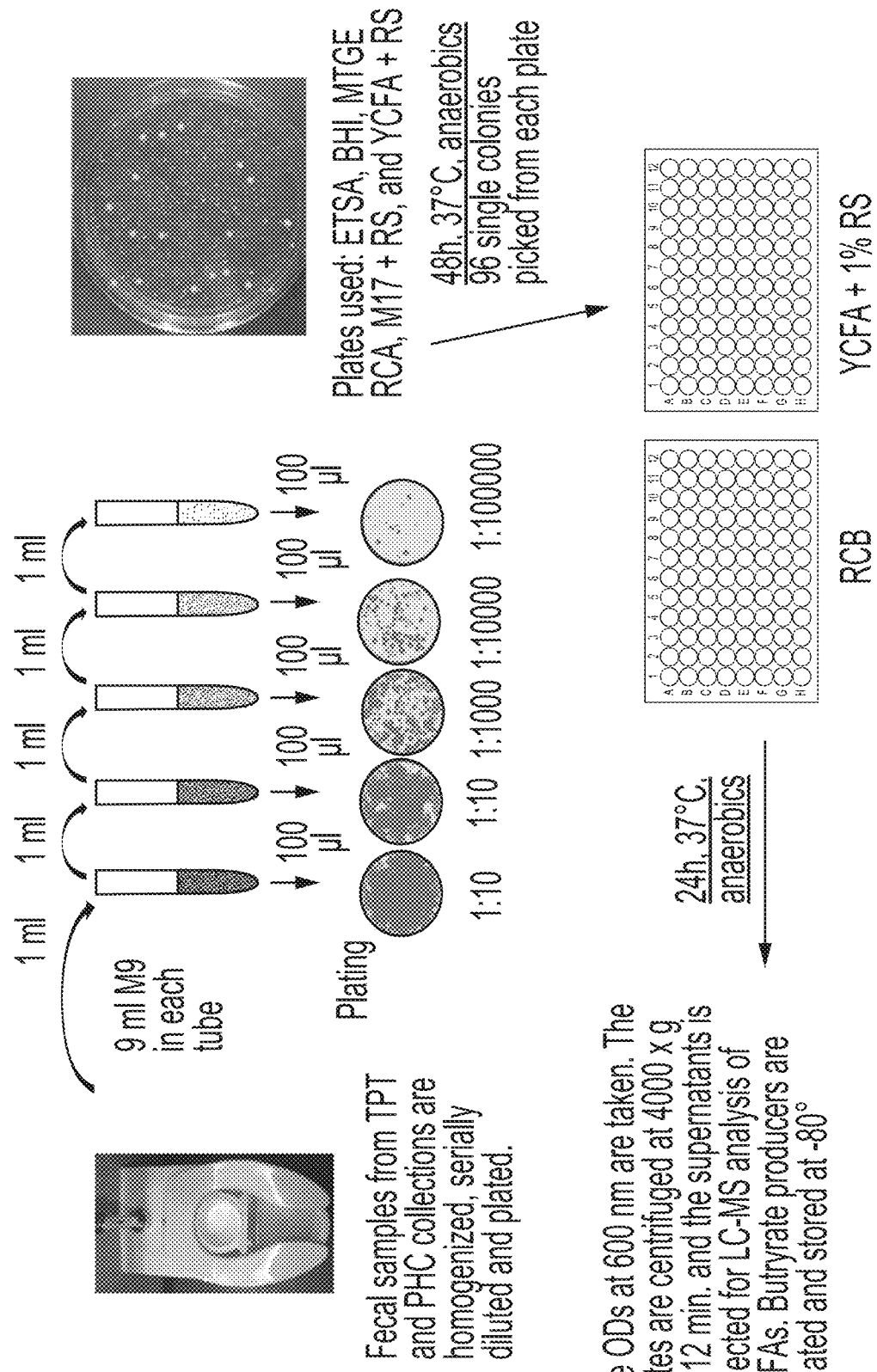
FIG. 1 shows the protocol for isolating, growing, and screening bacteria for production of short chain fatty acids (SCFA)/butyrate.
Figure 2:
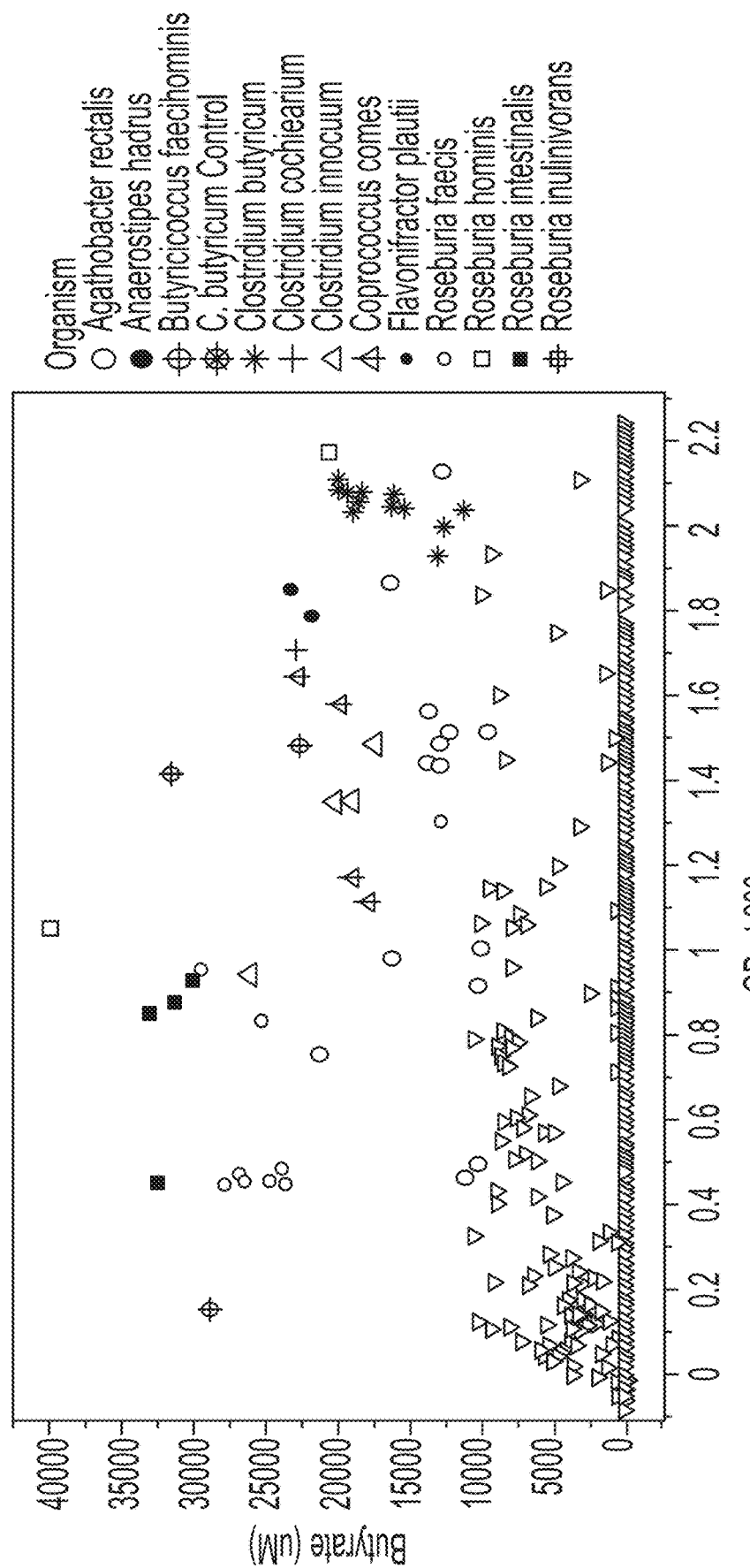
FIG. 2 shows results of screening of bacterial strains for growth and butyrate production on either YCFA or RCB. At least about 1700 bacterial isolates were screened with many showing either no growth or very low butyrate production. The amount of growth (OD 600 nm) is on the x-axis and butyrate production is on the y-axis. The identified bacteria show high butyrate production and diversity of their taxonomy. Dots of the same color represent different isolates.
Figure 6A:
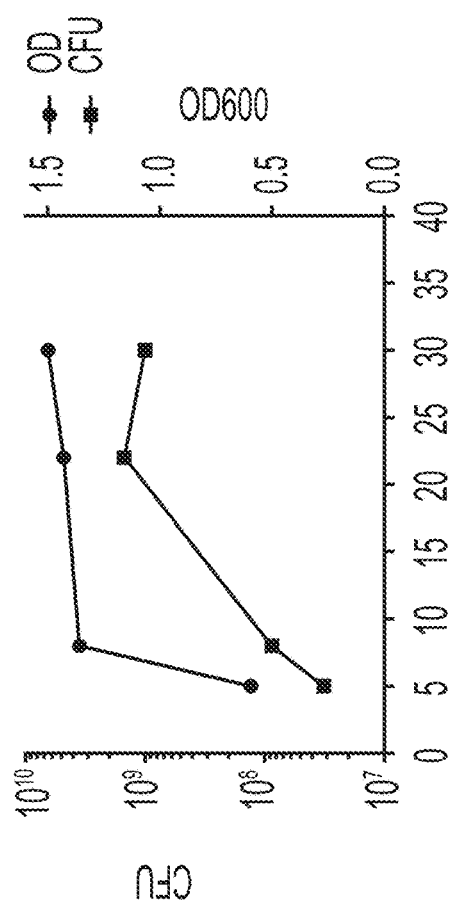
FIG. 6A-B show the growth curve and post-lyophilization survival for *Agathobacter rectalis* (RC2-6, i.e., SEQ ID NO: 11).
Figure 6B:
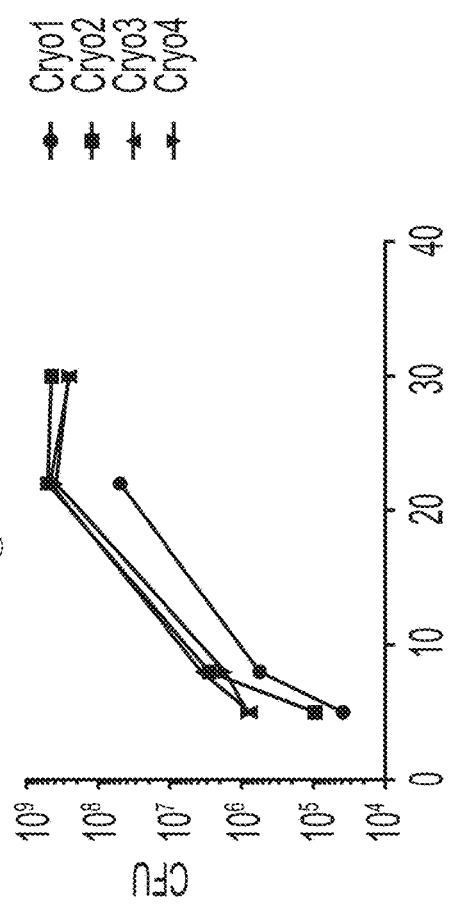
Figure 7A:
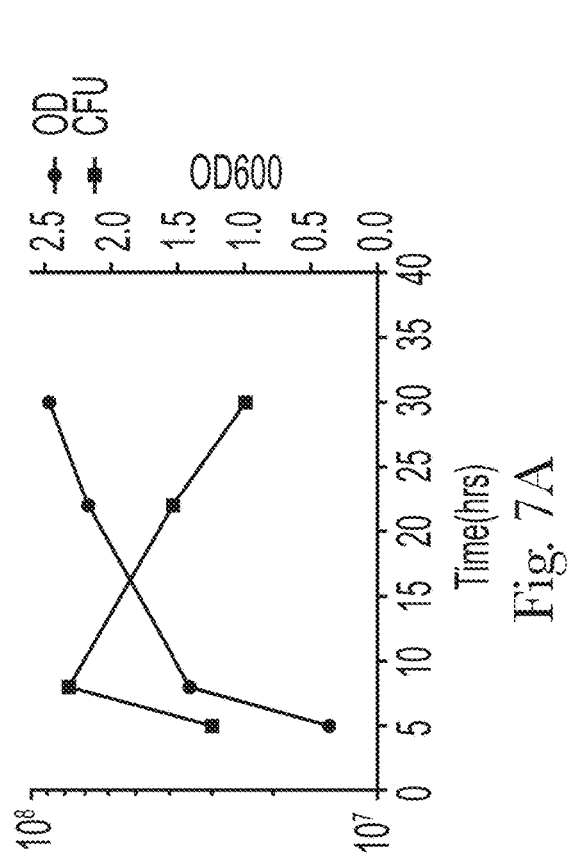
FIG. 7A-B show the growth curve and post-lyophilization survival for *Butyricicoccus faecihominis* (ODS-26, i.e., SEQ ID NO: 13).
Figure 7B:
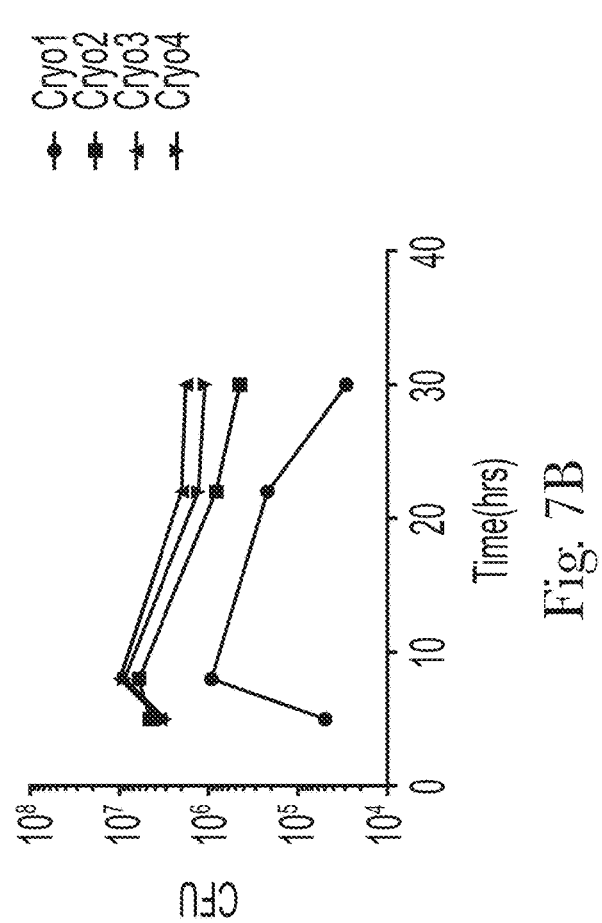
Figure 12A:
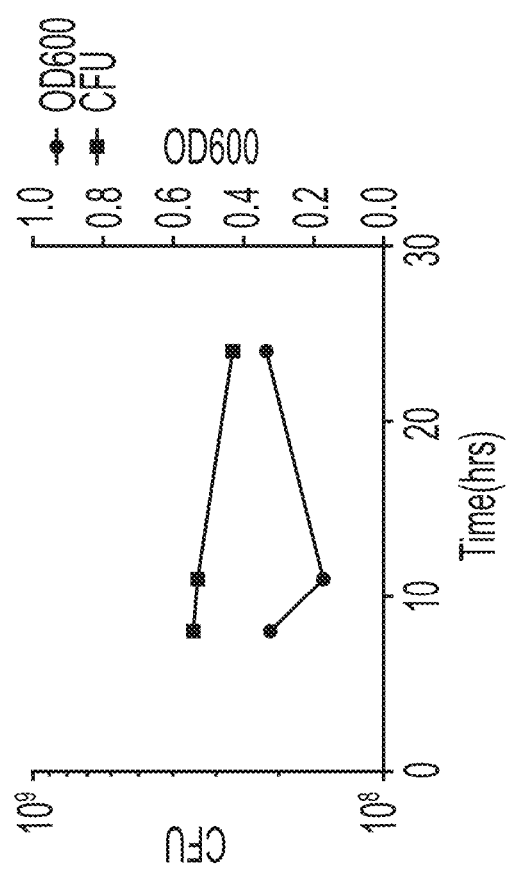
FIG. 12A-B show the growth curve and post-lyophilization survival for *Flavonifactor plautii* (FLM9MS-20, i.e., SEQ ID NO: 19).
Figure 12B:
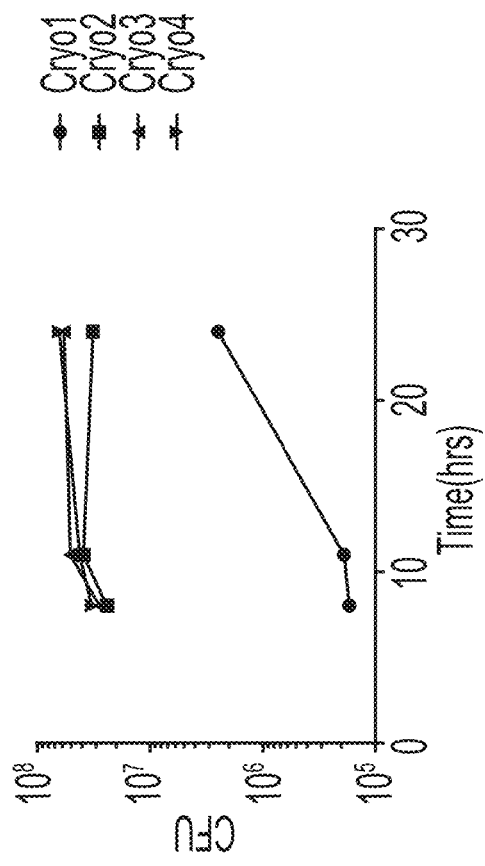

The disclosure provides probiotic bacterial strains or species that produce butyrate and associated compositions comprising the probiotic bacterial strains or species. The disclosed bacterial strains are suitable for delivery to the colon, where short chain fatty acids (SCFA) can be produced endogenously at their site of action, thereby providing health benefits. The health benefits may ease or ameliorate a variety of disorders, including metabolic, immune, intestinal, and inflammatory disorders. In certain embodiments, the bacterial strains or compositions are used in preparing food, supplements, pharmaceutical compositions, and other consumables to providing health benefits, including therapeutic applications, for a variety of disorders, including metabolic, immune, intestinal, and inflammatory disorders.

The terms "microbes" and "microorganisms" are used interchangeably herein to refer to bacteria. The terms "microbiome", "microbiota", and "microbial habitat" are used interchangeably herein and can refer to the ecological community of microorganisms that live on or in a subject's body. Microbiomes can exist on or in many, if not most parts of the subject. Some non-limiting examples of habitats of microbiome can include: body surfaces, body cavities, body fluids, the gut, the colon, skin surfaces and pores, vaginal cavity, umbilical regions, conjunctival regions, intestinal regions, the stomach, the nasal cavities and passages, the gastrointestinal tract, the urogenital tracts, saliva, mucus, and feces.

Bacteria are classified and identified to distinguish one organism from another and to group similar organisms using criteria of interest to microbiologists or other scientists. The bacterial species category defines an organism on the basis of genetic similarity, biochemical, and phenotypic criteria. Within one species, strains and subgroups can differ by the host response they elicit, their environmental habitat, and many other characteristics. A strain designation usually reflects descendants of a single organism and usually are classified based on unique characteristics defined by serotyping, enzyme typing, protein/nucleic acids/plasmid characterization, and functional characteristics important to probiotic strains including, but not limited to, undesirable bacteria inhibition, gastric acid tolerance, adhesion/colonization, hydrophobicity, and immunomodulatory cytokine production. DNA relatedness is used to group strains on the basis of overall genetic similarity.

The term "genome" as used herein, can refer to the entirety of an organism's hereditary information that is encoded in its primary DNA sequence. The genome includes both the genes and the non-coding sequences. For example, the genome, in some aspects, represents a microbial genome. The genetic content of the microbiome can comprise: genomic DNA, RNA, and ribosomal RNA, the epigenome, plasmids, and all other types of genetic information found in the microbes that comprise the microbiome.

In bacteria, the gene that has proven to be the most informative for investigating evolutionary relatedness is a 16S ribosomal RNA (16S-rRNA) encoding gene sequence, a sequence of DNA that encodes the RNA component of the smaller subunit of the bacterial ribosome. The 16S-rRNA encoding gene sequence is highly conserved evolutionarily among species of microorganisms. The 16S-rRNA encoding gene sequence is present in all bacteria, and a related form occurs in all cells, including those of eukaryotes. Consequently, sequencing of the 16S-rRNA subunit can be used to identify and/or compare microorganisms (e.g., bacteria) present in a sample (e.g., a microbiome). 16S-rRNA gene sequencing is a well-established method for studying phylogeny and taxonomy of samples from complex microbiomes or environments that are difficult to study. In various aspects, bacteria are identified by their 16S-rRNA sequence or 16S-rRNA encoding gene sequence.

"Nucleic acid sequence" and "nucleotide sequence" as used herein refer to an oligonucleotide or polynucleotide, and fragments or portions thereof, and to DNA or RNA of genomic or synthetic origin which may be single- or double-stranded, and represent the sense or antisense strand. The nucleic acid sequence can be made up of adenine, guanine, cytosine, thymine, and uracil (A, T, C, G, and U) as well as modified versions (e.g. N6-methyladenosine, 5-methylcytosine, etc.). The term "sequencing" as used herein refers to sequencing methods for determining the order of the nucleotide bases—A, T, C, G, and U- in a nucleic acid molecule (e.g., a DNA or RNA nucleic acid molecule). In some aspects of the disclosure, bacteria that produce the greatest levels of SCFA and exhibit tolerance for lyophilization were isolated, and the 16S-rRNA encoding gene sequence from each of these bacteria was sequenced. The 16S-rRNA encoding gene sequences of each of these bacteria (SEQ ID NOs: 1-23) are provided in Table 1.

TABLE 1

16S-rRNA encoding gene sequences of probiotic bacteria of the disclosure

| SEQ ID NO: | Bacteria | Nucleotide sequence |
|---|---|---|
| 1 | RC1-78 2795581 *Roseburia faecis* | TGGAGAGTTTGATCCTGGCTCAGGATGAACGCTGGCGGCGT GCTTAACACATGCAAGTCGAACGAAGCACTCTATTTGATTT YCTTCGGRAWTGAAGATTTTGTGACTGAGTGGCGGACGGG TGAGTAACGCGTGGGTAACCTGCCTCATACAGGGGGATAAC AGTTGGAAACGACTGCTAATACCGCATAAGCGCACAGGAT CGCATGATCYGGTGYGAAAAACTCCGGTGGTATGRGATGG ACCYGCGTCTGATTAGCCAGTTGGCAGGGTAACGGCCTACC AAAGCGACGATCAGTAGCCGACCTGAGAGGGTGACCGCC ACATTGGGACTGAGACACGGCCCAAACTCCTACGGGAGGC AGCAGTGGGGAATATTGCACAATGGGGGAAACCCTGATGC AGCGACGCCGCGTGAGCGAAGAAGTATTTCGGTATGTAAA GCTCTATCAGCAGGGAAGAAGAATGACGGTACCTGACTAA GAAGCACCGGCTAAATACGTGCCAGCAGCCGCGGTA |
| 2 | ODS-29 2795582 *Roseburia intestinalis* | TGGAGAGTTTGATCCTGGCTCAGGATGAACGCTGGCGGCGT GCTTAACACATGCAAGTCGAACGAAGCRCTTTAYTTGATYT CTTCGGARTGAWKRTTTTGTGACTGAGTGGCGGACGGGTGA GTAACGCGTGGGTAACCTGCCTCATACAGGGGGATAACAGT TGGAAACGACTGCTAATACCGCATAAGCGCACAGGGTCRC ATGRCCTGGTGTGAAAAACTCCGGTGGTATGAGATGGACCC GCGTCTGATTAGCCAGTTGGTGGGGTAACGGCCTACCAAAG CGACGATCAGTAGCCGACCTGAGAGGGTGACCGGCCACAT TGGGACTGAGACACGGCCCAAACTCCTACGGGAGGCAGCA GTGGGGAATATTGCACAATGGGGGAAACCCTGATGCAGCG ACGCCGCGTGAGCGAAGAAGTATTTCGGTATGTAAAGCTCT ATCAGCAGGGAAGAAGAAATGACGGTACCTGACTAAGAAG CACCGGCTAAATACGTGCCAGCAGCCGCGGTA |
| 3 | RC2-95 2795583 *Anaerostipes hadrus* | TGGAGAGTTTGATCCTGGCTCAGGATGAACGCTGGCGGCGT GCTTAACACATGCAAGTCGAACGAARCWSCTTAWYTGATY TTCTTCGGAAYTGAHGWTTTGKWGAYTGAGTGGCGGACGG GTGAGTAACGCGTGGGTAACCTRCCCTGTACAGGGGGATAA CAGTCAGAAATGACTGCTAATACYGCATAAGACCACAGCA CCGCATGGTGCAGGGGTAAAARCTCCGGTGGTACAGGATG GACCCGCGTCTGATTAGCTGGTTGGTGAGGTAACGGCTCAC CAAGGCGACGATCAGTAGCCGGCTTGAGAGAGTGAACGGC CACATTGGGACTGAGACACGGCCCAAACTCCTACGGGAGG CAGCAGTGGGGAATATTGCACAATGGGGGAAACCCTGATG CAGCGACGCCGCGTGAGTGAAGAAGTATCTCGGTATGTAA AGCTCTATCAGCAGGGAAGAAAATGACGGTACCTGACTAA GAAGCCCCGGCTAACTACGTGCCAGCAGCCGCGGTA |
| 4 | M17MSO.2-9 2795584 *Clostridium innocuum* | TGGAGAGTTTGATCCTGGCTCAGGATGAACGCTGGCGGCAT GCCTAATACATGCAAGTCGAACGAAGTTTCKAGGAAGCTTG CTTCCAAAGAGACTTAGTGGCGAACGGGTGAGTAACACGT AGGTAACCTGCCCATGTGTCCGGGATAACTGCTGGAAACGG TAGCTAAAACCGGATAGGTATACAGAGCGCATGCTCAGTAT ATTAAAGCGCCCATCAAGGCGTGAACATGGATGGACCTGC GGCGCATTAGCTAGTTGGTGAGGTAACGGCYCACCAAGGC GATGATGCGTAGCCGGCCTGAGAGGGTAAACGGCCACATT GGGACTGAGACACGGCCCAAACTCCTACGGGAGGCAGCAG TAGGGAATTTTCGTCAATGGGGGAAACCCTGAACGAGCAAT GCCGCGTGAGTGAAGAAGGTCTTCGGATCGTAAAGCTCTGT TGTAAGTGAAGAACGGCTCATAGAGGAAATGCTATGGGAG TGACGGTAGCTTACCAGAAAGCCACGGCTAACTACGTGCCA GCAGCCGCGGTA |
| 5 | RC1-219 2795585 *Clostridium innocuum* | TGGAGAGTTTGATCCTGGCTCAGGATGAACGCTGGCGGCAT GCCTAATACATGCAAGTCGAACGAAGTTTCGAGGAAGCTTG CTTCCAAAGAGACTTAGTGGCGAACGGGTGAGTAACACGT AGGTAACCTGCCCATGTGTCCGGGATAACTGCTGGAAACGG TAGCTAAAACCGGATAGGTATACAGAGCGCATGCTCAGTAT ATTAAAGCGCCCATCAAGGCGTGAACATGGATGGACCTGC |

TABLE 1-continued 16S-rRNA encoding gene sequences of probiotic bacteria of the disclosure

| SEQ ID NO: | Bacteria | Nucleotide sequence |
|---|---|---|
|  |  | GGCGCATTAGCTAGTTGGTGAGGTAACGGCCCACCAAGGCR ATGATGCGTAGCCGGCCTGAGAGGGTAAACGGCCACATTG GGACTGAGACACGGCCCAAACTCCTACGGGAGGCAGCAGT AGGGAATTTTCGTCAATGGGGGAAACCCTGAACGAGCAAT GCCGCGTGAGTGAAGAAGGTCTTCGGATCGTAAAGCTCTGT TGTAAGTGAAGAACGGCTCATAGAGGAAATGCTATGGGAG TGACGGTAGCTTACCAGAAAGCCACGGCTAACTACGTGCCA GCAGCCGCGGTA |
| 6 | YC2-268.2 2795588 *Clostridium butyricum* | TGGAGAGTTTGATCCTGGCTCAGGACGAACGCTGGCGGCGT GCTTAACACATGCAAGTCGAGCGATGAAGCTCCTTCGGGAG TGGATTAGCGGCGGACGGGTGAGTAACACGTGGGTAACCT GCCTCATAGAGGGGAATAGCCTTTCGAAAGGAAGATTAAT ACCGCATAAGATTGTAGTACCGCATGGTACAGCAATTAAAG GAGTAATCCGCTATGAGATGGACCCGCGTCGCATTAGCTAG TTGGTGAGGTAACGGCTCACCAAGGCGACGATGCGTAGCC GACCTGAGAGGGTGATCGGCCACATTGGGACTGAGACACG GCCCAGACTCCTACGGGAGGCAGCAGTGGGGAATATTGCA CAATGGGGGAAACCCTGATGCAGCAACGCCGCGTGAGTGA TGACGGTCTTCGGATTGTAAAGCTCTGTCTTTAGGGACGAT AATGACGGTACCTAAGGAGGAAGCCACGGCTAACTACGTG CCAGCAGCCGCGGTA |
| 7 | YC2-242.3 2795590 *Clostridium butyricum* | TGGAGAGTTTGATCCTGGCTCAGGACGAACGCTGGCGGCGT GCTTAACACATGCAAGTCGAGCGATGAAGCTCCTTCGGGAG TGGATTAGCGGCGGACGGGTGAGTAACACGTGGGTAACCT GCCTCATAGAGGGGAATAGCCTTTCGAAAGGAAGATTAAT ACCGCATAAGATTGTAGTACCGCATGGTACAGCAATTAAAG GAGTAATCCGCTATGAGATGGACCCGCGTCGCATTAGCTAG TTGGTGAGGTAACGGCTCACCAAGGCGACGATGCGTAGCC GACCTGAGAGGGTGATCGGCCACATTGGGACTGAGACACG GCCCAGACTCCTACGGGAGGCAGCAGTGGGGAATATTGCA CAATGGGGGAAACCCTGATGCAGCAACGCCGCGTGAGTGA TGACGGTCTTCGGATTGTAAAGCTCTGTCTTTAGGGACGAT AATGACGGTACCTAAGGAGGAAGCCACGGCTAACTACGTG CCAGCAGCCGCGGTA |
| 8 | VDS-14 2795591 *Coprococus comes* | TGGAGAGTTTGATCCTGGCTCAGGATGAACGCTGGCGGCGT GCTTAACACATGCAAGTCGAACGAAGCACTTAWMYYTGAT TCTTCGGATGAAGRKDTTTGTGACTGAGTGGCGGACGGGTG AGTAACGCGTGGGTAACCTGCCTCATACAGGGGGATAACA GTTAGAAATGACTGCTAATACCGCATAAGACCACAGRGYC GCATGRCTYGGTGGGAAAAACTCCGGTGGTATGAGATGGA CCCGCGTCTGATTAGGTAGTTGGTGGGGTAACGGCCTACCA AGCCAACGATCAGTAGCCGACCTGAGAGGGTGACCGGCCA CATTGGGACTGAGACACGGCCCAAACTCCTACGGGAGGCA GCAGTGGGGAATATTGCACAATGGGGGAAACCCTGATGCA GCGACGCCGCGTGAGCGAAGAAGTATTTCGGTATGTAAAG CTCTATCAGCAGGGAAGAAAATGACGGTACCTGACTAAGA AGCACCGGCTAAATACGTGCCAGCAGCCGCGGTA |
| 9 | MS-5.1 2795592 *Anaerostipes hadrus* | TGGAGAGTTTGATCCTGGCTCAGGATGAACGCTGGCGGCGT GCTTAACACATGCAAGTCGAACGAARCWSCTTAWYTGATY TTCTTCGGAAYTGAMGWTTTGKWGAYTGAGTGGCGGACGG GTGAGTAACGCGTGGGTAACCTGCCCTGTACAGGGGGATA ACAGTCAGAAATGACTGCTAATACCGCATAAGACCACAGC ACCGCATGGTGCAGGGGTAAAAACTCCGGTGGTACAGGAT GGACCCGCGTCTGATTAGCTGGTTGGTGAGGTAACGGCTCA CCAAGGCGACGATCAGTAGCCGGCTTGAGAGAGTGAACGG CCACATTGGGACTGAGACACGGCCCAAACTCCTACGGGAG GCAGCAGTGGGGAATATTGCACAATGGGGGAAACCCTGAT GCAGCGACGCCGCGTGAGTGAAGAAGTATCTCGGTATGTA AAGCTCTATCAGCAGGGAAGAAAATGACGGTACCTGACTA AGAAGCCCCGGCTAACTACGTGCCAGCAGCCGCGGTA |
| 10 | RC1-148 2795594 *Coprococus comes* | TGGAGAGTTTGATCCTGGCTCAGGATGAACGCTGGCGGCGT GCTTAACACATGCAAGTCGAACGAAGCACTTWWMYYTGAT TCTTCGGATGAAGRKDTTTGTGACTGAGTGGCGGACGGGTG AGTAACGCGTGGGTAACCTGCCTCRTACAGGGGGATAACA GTTAGAAATGACTGCTAATACCGCATAAGACCACACRGAGCY GCATGGCTCRGTGGGAAAAACTCCGGTGGTATGAGATGGA CCCGCGTCTGATTAGGTAGTTGGTGGGGTAACGGCCTACCA AGCCAACGATCAGTAGCCGACCTGAGAGGGTGACCGGCCA CATTGGGACTGAGACACGGCCCAAACTCCTACGGGAGGCA GCAGTGGGGAATATTGCACAATGGGGGRAACCCTGATGCA |

TABLE 1-continued

16S-rRNA encoding gene sequences of probiotic bacteria of the disclosure

| SEQ ID NO: | Bacteria | Nucleotide sequence |
|---|---|---|
| | | GCGACGCCGCGTGAGCGAAGAAGTATTTCGGTATGTAAAG<br>CTCTATCAGCAGGGAAGAAAATGACGGTACCTGACTAAGA<br>AGCACCGGCTAAATACGTGCCAGCAGCCGCGGTA |
| 11 | RC2-6<br>2795595<br>*Agathobacter rectalis* | TGGAGAGTTTGATCCTGGCTCAGGATGAACGCTGGCGGCGT<br>GCTTAACACATGCAAGTCGAACGAAGCACTTTATTTGATTT<br>CCTTCGGGAYTGATTATTTTGTGACTGAGTGGCGGACGGGT<br>GAGTAACGCGTGGGTAACCTGCCTTGTACAGGGGGATAAC<br>AGTTGGAAACGGCTGCTAATACCGCATAAGCGCACRGCATC<br>GCATGATGCAGTGTGAAAAACTCCGGTGGTATAAGATGGA<br>CCCGCGTTGGATTAGCTAGTTGGTGAGGTAACGGCCCACCA<br>AGGCGACGATCCATAGCCGACCTGAGAGGGTGACCGGCCA<br>CATTGGGACTGAGACACGGCCCAAACTCCTACGGGAGGCA<br>GCAGTGGGGAATATTGCACAATGGGCGAAAGCCTGATGCA<br>GCGACGCCGCGTGAGCGAAGAAGTATTTCGGTATGTAAAG<br>CTCTATCAGCAGGGAAGATAATGACGGTACCTGACTAAGA<br>AGCACCGGCTAAATACGTGCCAGCAGCCGCGGTA |
| 12 | YC1-37<br>2795596<br>*Agathobacter rectalis* | TGGAGAGTTTGATCCTGGCTCAGGATGAACGCTGGCGGCGT<br>GCTTAACACATGCAAGTCGAACGAAGCACTTTATTTGATTT<br>CCTTCGGGACTGATTATTTTGTGACTGAGTGGCGGACGGGT<br>GAGTAACGCGTGGGTAACCTGCCTTGTACAGGGGGATAAC<br>AGTTGGAAACGGCTGCTAATACCGCATAAGCGCACRGCATC<br>GCATGRTGCAGTGTGAAAAACTCCGGTGGTATAAGATGGAC<br>CCGCGTTGGATTAGCTAGTTGGTGAGGTAACGGCCCACCAA<br>GGCGACGATCCATAGCCGACCTGAGAGGGTGACCGGCCAC<br>ATTGGGACTGAGACACGGCCCAAACTCCTACGGGAGGCAG<br>CAGTGGGGAATATTGCACAATGGGCGAAAGCCTGATGCAG<br>CGACGCCGCGTGAGCGAAGAAGTATTTCGGTATGTAAAGCT<br>CTATCAGCAGGGAAGATAATGACGGTACCTGACTAAGAAG<br>CACCGGCTAAATACGTGCCAGCAGCCGCGGTA |
| 13 | ODS-26<br>2795597<br>*Butyricicoccus faecihominis* | TGGAGAGTTTGATCCTGGCTCAGGATGAACGCTGGCGGCGT<br>GCCTAACACATGCAAGTCGAACGGARYYRTTTTGGAAAHY<br>YCTTCGGRRDYGGAATYYTYRRYTTAGTGGCGGACGGGTG<br>AGTAACGCGTGAGCAATCTGCCTTTAAGAGGGGGATAACA<br>GTCGGAAACGGCTGCTAATACCGCATAAAGCATYRAAWYC<br>GCATGWTTTTGATGCCAAAGGAGCAATCCGCTTTTAGATGA<br>GCTCGCGTCTGATTAGCTRGTTGGCGGGGYAACGGCCCACC<br>AAGGCGACGATCAGTAGCCGGACTGAGAGGTTGAACGGCC<br>ACATTGGGACTGAGACACGGCCCAGACTCCTACGGGAGGC<br>AGCAGTGGGGAATATTGCGCAATGGGGGAAACCCTGACGC<br>AGCAACGCCGCGTGATTGAAGAAGGCCTTCGGGTTGTAAA<br>GATCTTTAATCAGGGACGAAACAAATGACGGTACCTGAAG<br>AATAAGCTCCGGCTAACTACGTGCCAGCAGCCGCGGTA |
| 14 | RC-135.2<br>2795598<br>*Butyricicoccus faecihominis* | TGGAGAGTTTGATCCTGGCTCAGGATGAACGCTGGCGGCGT<br>GCCTAACACATGCAAGTCGAACGRARYYRTTTTGGAAAYY<br>YCTTCGGRRRYGGAATHYTYRRYTTAGTGGCGGACGGGTGA<br>GTAACGCGTGAGCAATCTGCCTTTAAGAGGGGGATAACAGT<br>CGGAAACGGCTGCTAATACCGCATAAAGCATYRAAWYCGC<br>ATGWTTTTGATGCCAAAGGAGCAATCCGCTTTTAGATGAGC<br>TCGCGTCTGATTAGCTRGTTGGCGGGGTAACGGCCCACCAA<br>GGCGACGATCAGTAGCCGGACTGAGAGGTTGAACGGCCAC<br>ATTGGGACTGAGACACGGCCCAGACTCCTACGGGAGGCAG<br>CAGTGGGGAATATTGCGCAATGGGGRAACCCTGACGCAG<br>CAACGCCGCGTGATTGAAGAAGGCCTTCGGGTTGTAAAGAT<br>CTTTAATCAGGGACGAAACAAATGACGGTACCTGAAGAAT<br>AAGCTCCGGCTAACTACGTGCCAGCAGCCGCGGTA |
| 15 | MS-25<br>2795599<br>*Anaerostipes caccae* | TGGAGAGTTTGATCCTGGCTCAGGATGAACGCTGGCGGCGT<br>GCTTAACACATGCAAGTCGAACGAAGCATTTAGGATTGAAG<br>TTTTCGGATGGATTTCCTATATGACTGAGTGGCGGACGGGT<br>GAGTAACGCGTGGGGAACCTGCCCTATACAGGGGGATAAC<br>AGCTGGAAACGGCTGCTAATACCGCATAAGCGCACAGAAT<br>CGCATGATTCAGTGTGAAAAGCCCTGGCAGTATAGGATGGT<br>CCCGCGTCTGATTAGCTGGTTGGTGAGGTAACGGCTCACCA<br>AGGCGACGATCAGTAGCCGGCTTGAGAGAGTGAACGGCCA<br>CATTGGGACTGAGACACGGCCCAAACTCCTACGGGAGGCA<br>GCAGTGGGGAATATTGCACAATGGGGGAAACCCTGATGCA<br>GCGACGCCGCGTGAGTGAAGAAGTATTCGGTATGTAAAGC<br>TCTATCAGCAGGGAAGAAAACAGACGGTACCTGACTAAGA<br>AGCCCCGGCTAACTACGTGCCAGCAGCCGCGGTA |

TABLE 1-continued 16S-rRNA encoding gene sequences of probiotic bacteria of the disclosure

| SEQ ID NO: | Bacteria | Nucleotide sequence |
|---|---|---|
| 16 | RC1-364 2795600 *Roseburia intestinalis* | TGGAGAGTTTGATCCTGGCTCAGGATGAACGCTGGCGGCGT GCTTAACACATGCAAGTCGAACGAAGCACTYTAYTTGATYT CTTCGGARTGAWKRTTTTGTGACTGAGTGGCGGACGGGTGA GTAACGCGTGGGTAACCTGCCTCATACAGGGGGATAACAGT TGGAAACGACTGCTAATACCGCATAAGCGCACAGGGTCGC ATGACCTGGTGTGAAAAACTCCGGTGGTATGAGATGGACCC GCGTCTGATTAGCCAGTTGGTGGGGTAACGGCCTACCAAAG CGACGATCAGTAGCCGACCTGAGAGGGTGACCGGCCACAT TGGGACTGAGACACGGCCCAAACTCCTACGGGAGGCAGCA GTGGGGAATATTGCACAATGGGGGAAACCCTGATGCAGCG ACGCCGCGTGAGCGAAGAAGTATTTCGGTATGTAAAGCTCT ATCAGCAGGGAAGAAGAAATGACGGTACCTGACTAAGAAG CACCGGCTAAATACGTGCCAGCAGCCGCGGTA |
| 17 | MS-108 2795601 *Roseburia faecis* | TGGAGAGTTTGATCCTGGCTCAGGATGAACGCTGGCGGCGT GCTTAACACATGCAAGTCGAACGAAGCACTCTATTTGATTT TCTTCGGAAATGAAGATTTTGTGACTGAGTGGCGGACGGGT GAGTAACGCGTGGGTAACCTGCCTCATACAGGGGGATAAC AGTTGGAAACGACTGCTAATACCGCATAAGCGCACAGGAT YGCATGATCCGGTGTGAAAAACTCCGGTGGTATGRGATGGA CCCGCGTCTGATTAGCCAGTTGGCAGGGTAACGGCCTACCA AAGCGACGATCAGTAGCCGACCTGAGAGGGTGACCGGCCA CATTGGGACTGAGACACGGCCCAAACTCCTACGGGAGGCA GCAGTGGGGAATATTGCACAATGGGGGAAACCCTGATGCA GCGACGCCGCGTGAGCGAAGAAGTATTTCGGTATGTAAAG CTCTATCAGCAGGGAAGAAGAATGACGGTACCTGACTAAG AAGCACCGGCTAAATACGTGCCAGCAGCCGCGGTA |
| 18 | YC1-202 2795602 *Clostridium cochlearlum* | TGGAGAGTTTGATCCTGGCTCAGGACGAACGCTGGCGGCGT GCTTAACACATGCAAGTCGAGCGATGAAGCTTCCTTCGGGA AGTGGATTAGCGGCGGACGGGTGAGTAACACGTGGGYAAC CTGCCTCAAAGAGRGGAATAGCCCTCCGAAAGGAGGATTA ATACCGCATAAAGTTAGAGTTTCGCATGAAACTTTAACCAA AGGAGYAATCYGCTTTGAGATGGGCCCGCGTCCCATTAGCT AGTTGGTARGGTAATGGCTTACCAAGGCAACGATGGGTAGC CGACCTGAGAGGGTGATCGGCCACATTGGAACTGAGACAC GGTCCAGACTCCTACGGGAGGCAGCAGTGGGGAATATTGC GCAATGGGGGAAACCCTGACGCAGCAACGCCGCGTGGGTG ATGAAGGTTTTCGGATCGTAAARCCCTGTTTTCTGGGACGA TAATGACGGTACCAGATGAGGAAGCCACGGCTAACTACGT GCCAGCAGCCGCGGTA |
| 19 | MS-20 2795603 *Flavonifractor plautii* | TGGAGAGTTTGATCCTGGCTCAGGATGAACGCTGGCGGCGT GCTTAACACATGCAAGTCGAACGGGGTGCTCATGACGGAG GATTCGTCCAACGGATTGAGTTACCTAGTGGCGGACGGGTG AGTAACGCGTGAGGAACCTGCCTTGGAGAGGGGAATAACA CTCCGAAAGGAGTGCTAATACCGCATGATGCAGTTGGGTCG CATGGCTCTGACTGCCAAAGATTTATCGCTCTGAGATGGCC TCGCGTCTGATTAGCTAGTAGGCGGGGTAACGGCCCACCTA GGCGACGATCAGTAGCCGGACTGAGAGGTTGACCGGCCAC ATTGGGACTGAGACACGGCCCAGACTCCTACGGGAGGCAG CAGTGGGGAATATTGGGCAATGGGCGCAAGCCTGACCCAG CAACGCCGCGTGAAGGAAGAAGGCTTTCGGGTTGTAAACTT CTTTTGTCGGGGACGAAACAAATGACGGTACCCGACGAATA AGCCACGGCTAACTACGTGCCAGCAGCCGCGGTA |
| 20 | MS-70 2795604 *Roseburia faecis* | TGGAGAGTTTGATCCTGGCTCAGGATGAACGCTGGCGGCGT GCTTAACACATGCAAGTCGAACGAAGCACTCTATTTGATTT TCTTCGGAAATGAAGATTTTGTGACTGAGTGGCGGACGGGT GAGTAACGCGTGGGTAACCTGCCTCATACAGGGGGATAAC AGTTGGAAACGACTGCTAATACCGCATAAGCGCACAGGAT YGCATGATCCGGTGTGAAAAACTCCGGTGGTATGRGATGGA CCCGCGTCTGATTAGCCAGTTGGCAGGGTAACGGCCTACCA AAGCGACGATCAGTAGCCGACCTGAGAGGGTGACCGGCCA CATTGGGACTGAGACACGGCCCAAACTCCTACGGGAGGCA GCAGTGGGGAATATTGCACAATGGGGGAAACCCTGATGCA GCGACGCCGCGTGAGCGAAGAAGTATTTCGGTATGTAAAG CTCTATCAGCAGGGAAGAAGAATGACGGTACCTGACTAAG AAGCACCGGCTAAATACGTGCCAGCAGCCGCGGTA |
| 21 | RC1-32 2795605 *Roseburia hominis* | TGGAGAGTTTGATCCTGGCTCAGGATGAACGCTGGCGGCGT GCTTAACACATGCAAGTCGAACGAAGCACTTTAATTGATTT CTTCGGAATGAAGTTTTTGTGACTGAGTGGCGGACGGGTGA GTAACGCGTGGGTAACCTGCCTCATACAGGGGGATAACAGT TGGAAACGACTGCTAATACCGCATAAGCGCACRGGATTGCA |

TABLE 1-continued 16S-rRNA encoding gene sequences of probiotic bacteria of the disclosure

| SEQ ID NO: | Bacteria | Nucleotide sequence |
|---|---|---|
|  |  | TGATCCAGTGTGAAAAACTCCGGTGGTATGAGATGGACCCG<br>CGTCTGATTAGCCAGTTGGCGGGGTAACGGCCCACCAAAGC<br>GACGATCAGTAGCCGACCTGAGAGGGTGACCGGCCACATT<br>GGGACTGAGACACGGCCCAAACTCCTACGGGAGGCAGCAG<br>TGGGGAATATTGCACAATGGGGGAAACCCTGATGCAGCGA<br>CGCCGCGTGAGCGAAGAAGTATTTCGGTATGTAAAGCTCTA<br>TCRGCAGGGAAGAAGAATGACGGTACCTGACTAAGAAGCA<br>CCGGCTAAATACGTGCCAGCAGCCGCGGTA |
| 22 | YC1-156<br>2795607<br>*Roseburia*<br>*inulinivorans* | TGGAGAGTTTGATCCTGGCTCAGGATGAACGCTGGCGGCGT<br>GCTTAACACATGCAAGTCGAACGAAGCACTTTDAYHGATTT<br>CTTCGGAWWGAARTTTTAGTGACTGAGTGGCGGACGGGTG<br>AGTAACGCGTGGGTAACCTGCCTCACACAGGGGGATAACA<br>GWTGGAAACGGCTGCTAATACCGCATAAGCGCACARTACC<br>GCATGGTACAGTGTGAAAAACTCCGGTGGTGTGAGATGGA<br>CCCGCGTCTGATTAGCTAGTTGGCAGGGCARCGGCCTACCA<br>AGGCGACGATCAGTAGCCGACCTGAGAGGGTGACCGGCCA<br>CATTGGGACTGAGACACGGCCCAAACTCCTACGGGAGGCA<br>GCAGTGGGGAATATTGCACAATGGGGGAAACCCTGATGCA<br>GCGACGCCGCGTGAGCGAAGAAGTATTTCGGTATGTAAAG<br>CTCTATCAGCAGGGAAGAAGAAATGACGGTACCTGACTAA<br>GAAGCACCGGCTAAATACGTGCCAGCAGCCGCGGTA |
| 23 | RC1-143<br>2796669<br>*Roseburia*<br>*faecis* | TGGAGAGTTTGATCCTGGCTCAGGATGAACGCTGGCGGCGT<br>GCTTAACACATGCAAGTCGAACGAAGCACTCTATTTGATTT<br>TCTTCGGAAATGAAGATTTTGTGACTGAGTGGCGGACGGGT<br>GAGTAACGCGTGGGTAACCTGCCTCATACAGGGGGATAAC<br>AGTTGGAAACGACTGCTAATACCGCATAAGCGCACAGGAT<br>YGCATGATCYGGTGTGAAAAACTCCGGTGGTATGGGATGG<br>ACCCGCGTCTGATTAGCCAGTTGGCAGGGTAACGGCCTACC<br>AAAGCGACGATCAGTAGCCGACCTGAGAGGGTGACCGGCC<br>ACATTGGGACTGAGACACGGCCCAAACTCCTACGGGAGGC<br>AGCAGTGGGGAATATTGCACAATGGGGGAAACCCTGATGC<br>AGCGACGCCGCGTGAGCGAAGAAGTATTTCGGTATGTAAA<br>GCTCTATCAGCAGGGAAGAAGAATGACGGTACCTGACTAA<br>GAAGCACCGGCTAAATACGTGCCAGCAGCCGCGGTA |

\*R = A or G; Y = C or T; K = G or T; M = A or C; S = G or C; and W = A or T as set out in standard ambiguity codes

TABLE 2

Whole genomic DNA sequences of probiotic bacteria of the disclosure*

| SEQ ID NO: | Bacteria |
|---|---|
| 24 | *Roseburia faecis* |
| 25 | *Roseburia intestinalis* |
| 26 | *Anaerostipes hadrus* |
| 27 | *Clostridium innocuum* |
| 28 | *Clostridium butyricum* |
| 29 | *Coprococcus comes* |
| 30 | *Agathobacter rectalis* |
| 31 | *Butyricicoccus faecihominis* |
| 32 | *Anaerostipes caccae* |
| 33 | *Flavonifractor plautii* |
| 34 | *Roseburia hominis* |
| 35 | *Roseburia inulinivorans* |

*Because of the very large size of these whole genomic sequences for bacteria of the disclosure, these sequences are provided solely in the sequence listing which is part of the disclosure.

In some aspects, bacteria comprise nucleic acid sequences having a particular degree of homology or identity to other bacteria. The terms "identity," "homology," and "homologous" as used herein refer to a degree of complementarity or shared similarity with other nucleotide sequences. There may be partial homology or complete homology (i.e., identical sequences). A nucleotide sequence which is partially complementary, i.e., "substantially homologous" or "substantially identical" to a nucleic acid sequence is one that at least partially inhibits a completely complementary sequence from hybridizing to a target nucleic acid sequence. In some aspects, bacteria of the disclosure comprise a 16S-rRNA encoding gene sequence that is at least about 60%, at least about 61%, at least about 62%, at least about 63%, at least about 64%, at least about 65%, at least about 66%, at least about 67%, at least about 68%, at least about 69%, at least about 70%, at least about 71%, at least about 72%, at least about 73%, at least about 74%, at least about 75%, at least about 76%, at least about 77%, at least about 78%, at least about 79%, at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, or at least about 99% homologous or identical (100% homologous) to any one of the nucleotide sequences of SEQ ID NOs: 1-23. In some aspects, bacteria of the disclosure comprise a DNA sequence that is at least about 60%, at least about 61%, at least about 62%, at least about 63%, at least about 64%, at least about 65%, at least about 66%, at least about 67%, at least about 68%, at least about 69%, at least about 70%, at least about 71%, at least about 72%, at least about 73%, at least about 74%, at least about 75%, at least about 76%, at least about 77%, at least about 78%, at least about 79%, at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, or at least about 99% homologous or identical (100% homologous) to any one of the nucleotide sequences of SEQ ID NOs: 24-35. In some aspects, the whole genome sequence of bacteria of the disclosure is found in any one of the nucleotide sequences of SEQ ID NOs: 24-35.

In some aspects, a bacteria comprising the nucleotide sequences of any one of SEQ ID NOs: 1-35 is a probiotic or a probiotic bacteria. As used herein, the term "probiotic" means microbial cell preparations or components of microbial cells with a beneficial effect on the health or well-being of the host. (Salminen et al., Trends Food Sci. Technol. 10 107-10, 1999). The term "probiotic" as used herein can mean one or more microorganisms (e.g., bacteria) which, when administered appropriately, can confer a health benefit on the subject.

Some non-limiting examples of probiotics of the disclosure include, but are not limited to, bacteria, such as *Agathobacter rectalis* (formerly *Eubacterium rectale*), *Akkermansia muciniphila*, *Anaerostipes caccae*, *Anaerostipes hadrus*, *Bifidobacterium adolescentis*, *Bifidobacterium bifidum*, *Bifidobacterium infantis*, *Bifidobacterium longum*, *Butyricicoccus faecihominis*, *Butyrivibrio fibrisolvens*, *Clostridium acetobutylicum*, *Clostridium aminophilum*, *Clostridium beijerinckii*, *Clostridium butyricum*, *Clostridium cochlearium*, *Clostridium colinum*, *Clostridium indolis*, *Clostridium innocuum*, *Clostridium orbiscindens*, *Enterococcus faecium*, *Eubacterium hallii*, *Eubacterium rectale*, *Faecalibacterium prausnitzii*, *Fibrobacter succinogenes*, *Flavonifactor plautii*, *Lactobacillus acidophilus*, *Lactobacillus brevis*, *Lactobacillus bulgaricus*, *Lactobacillus casei*, *Lactobacillus caucasicus*, *Lactobacillus fermentum*, *Lactobacillus helveticus*, *Lactobacillus lactis*, *Lactobacillus plantarum*, *Lactobacillus reuteri*, *Lactobacillus rhamnosus*, *Oscillospira guilliermondii*, *Roseburia cecicola*, *Roseburia faecis*, *Roseburia hominis*, *Roseburia intestinalis*, *Roseburia inulinivorans*, *Ruminococcus flavefaciens*, *Ruminococcus gnavus*, *Ruminococcus obeum*, *Streptococcus cremoris*, *Streptococcus faecium*, *Streptococcus infantis*, *Streptococcus mutans*, *Streptococcus thermophilus*, *Anaerofustis stercorihominis*, *Anaerostipes hadrus*, *Anaerotruncus colihominis*, *Clostridium sporogenes*, *Clostridium tetani*, *Coprococcus*, *Coprococcus comes*, *Coprococcus eutactus*, *Eubacterium cylindroides*, *Eubacterium dolichum*, *Eubacterium ventriosum*, *Roseburia faeccis*, *Roseburia hominis*, *Roseburia intestinalis*, and any combination or mixtures thereof.

In particular aspects, the probiotic is a bacteria including, but not limited to, *Agathobacter rectalis*, *Anaerostipes caccae*, *Anaerostipes hadrus*, *Butyricicoccus faecihominis*, *Clostridium butyricum*, *Clostridium cochlearium*, *Clostridium innocuum*, *Coprococcus comes*, *Flavonifactor plautii*, *Roseburia faecis*, *Roseburia hominis*, *Roseburia intestinalis*, and *Roseburia inulinivorans*, and any combination or mixtures thereof.

As set out above, the bacteria of the disclosure are of interest because of their ability to produce short chain fatty acids (SCFA). In some aspects, bacteria of the disclosure produce at least about 0.5 millimoles (mmol) of the SCFA, at least about 0.6 mmol of the SCFA, at least about 0.7 mmol of the SCFA, at least about 0.8 mmol of the SCFA, at least about 0.9 mmol of the SCFA, at least about 1.0 mmol of the SCFA, at least about 1.2 mmol of the SCFA, at least about 1.4 mmol of the SCFA, at least about 1.6 mmol of the SCFA, at least about 1.8 mmol of the SCFA, at least about 2.0 mmol of the SCFA, at least about 2.2 mmol of the SCFA, at least about 2.4 mmol of the SCFA, at least about 2.6 mmol of the SCFA, at least about 2.8 mmol of the SCFA, at least about 3.0 mmol of the SCFA, at least about 3.2 mmol of the SCFA, at least about 3.4 mmol of the SCFA, at least about 3.6 mmol of the SCFA, at least about 3.8 mmol of the SCFA, at least about 4.0 mmol of the SCFA, at least about 4.2 mmol of the SCFA, at least about 4.4 mmol of the SCFA, at least about 4.4 mmol of the SCFA, at least about 4.6 mmol of the SCFA, at least about 4.8 mmol of the SCFA, at least about 5.0 mmol of the SCFA, at least about 5.5 mmol of the SCFA, at least about 6.0 mmol of the SCFA, at least about 6.5 mmol of the SCFA, at least about 7.0 mmol of the SCFA, at least about 7.5 mmol of the SCFA, at least about 8.0 mmol of the SCFA, at least about 8.5 mmol of the SCFA, at least about 9.0 mmol of the SCFA, at least about 9.5 mmol of the SCFA, at least about 10 mmol of the SCFA, at least about 11 mmol of the SCFA, at least about 12 mmol of the SCFA, at least about 13 mmol of the SCFA, at least about 14 mmol of the SCFA, at least about 15 mmol of the SCFA, at least about 16 mmol of the SCFA, at least about 17 mmol of the SCFA, at least about 18 mmol of the SCFA, at least about 19 mmol of the SCFA, at least about 20 mmol of the SCFA, at least about 25 mmol of the SCFA, at least about 30 mmol of the SCFA, at least about 35 mmol of the SCFA, at least about 40 mmol of the SCFA, at least about 45 mmol of the SCFA, at least about 50 mmol of the SCFA, at least about 55 mmol of the SCFA, at least about 60 mmol of the SCFA, at least about 65 mmol of the SCFA, at least about 70 mmol of the SCFA, at least about 75 mmol of the SCFA, at least about 80 mmol of the SCFA, at least about 85 mmol of the SCFA, at least about 90 mmol of the SCFA, at least about 95 mmol of the SCFA, at least about 100 mmol of the SCFA, at least about 110 mmol of the SCFA, at least about 120 mmol of the SCFA, at least about 130 mmol of the SCFA, at least about 140 mmol of the SCFA, at least about 150 mmol of the SCFA, at least about 160 mmol of the SCFA, at least about 170 mmol of the SCFA, at least about 180 mmol of the SCFA, at least about 190 mmol of the SCFA, at least about 200 mmol of the SCFA, at least about 250 mmol of the SCFA, or at least about 300 mmol of the SCFA over a period of about 24 hours.

In some aspects, SCFA production ranges from about 1 millimole over about 24 hours to about 300 millimoles over about 24 hours. In some aspects, SCFA production ranges from about 1 millimole over about 24 hours to about 100 millimoles over about 24 hours. In some aspects, SCFA production ranges from about 1 millimole over about 24 hours to about 50 millimoles over about 24 hours. In some aspects, SCFA production ranges from about 4 millimoles over about 24 hours to about 40 millimoles over about 24 hours.

In some aspects, such amount or concentration of SCFA is measured over a period of time which varies from about 24 hours. For example, in some aspects, the SCFA production is measured over a period of about 12 hours, over a period of about 36 hours, over a period of about 2 days, over a period of about 3 days, over a period of about 4 days, over a period of about 5 days, over a period of about 6 days, over a period of about a week, and the like. In those aspects, the amount of SCFA production, therefore, will be greater or lesser than what is disclosed herein for a period of about 24 hours. In particular aspects, the SCFA is measured over a period of about 24 hours.

In various aspects, the SCFA is acetate, butyrate, or propionate, or combinations thereof. In particular aspects, the SCFA is butyrate. Thus, in some more particular aspects, the production of butyrate is measured over a period of about 24 hours.

As described herein, SCFA are known to be important for intestinal health and metabolic functions. The health benefits of SCFA, especially butyrate, include, but are not limited to, anti-inflammatory activity, maintenance of the gut epithelial barrier, pathogen inhibition by lowering the local pH, and increasing mucus production. In various aspects, the SCFA produced by the bacteria include, but are not limited to, acetic acid, prop-ionic acid, butyric (i.e., butanoic) acid, isobutyric (i.e., isobutanoic) acid, valeric (i.e., pentanoic) acid, or isovaleric (i.e., isopentanoic) acid, or combinations thereof, often referred to by their conjugate bases, e.g, acetate, propionate, butyrate (i.e., butanoate), isobutyrate (i.e., isobutanoate), valerate (i.e., pentanoate), isovalerate (i.e., isopentanoate), or combinations thereof. In some aspects, the SCFA produced by the bacteria is butyrate.

Thus, the disclosure includes bacteria that modulate or increase butyrate production. In the colon, dietary fiber can be processed by butyrate-producing microorganisms to produce butyrate (i.e., butanoate). In turn, butyrate can initiate G-protein coupled receptor (GPCR) signaling, leading to glucagon-like peptide-1 (GLP-1) secretion which can result in increased insulin sensitivity and/or decreased appetite. By altering the butyrate-producing microbiome in a subject, the pathway responsible for insulin sensitivity can be stimulated. In some subjects, insulin sensitivity can be increased and/or restored to pre-diabetic levels with a microbial composition.

In some aspects, the bacteria of the disclosure is provided in a composition (i.e., a probiotic composition). In some aspects, various types of bacteria of the disclosure are combined in the composition. In particular aspects, the composition comprises at least one human isolate of SCFA-producing bacteria or mixtures thereof, wherein the bacteria comprises a 16S-rRNA encoding gene sequence that is at least about 80% identical to any one of the nucleotide sequences of SEQ ID NOs: 1-23, or a whole genome DNA sequence that is at least about 80% identical to any one of the nucleotide sequences of SEQ ID NOs: 24-35, and an excipient, carrier, and/or diluent. In various aspects, the mixture is any two or more bacteria. Thus, the mixture may comprise three or more, four or more, five or more, six or more, seven or more, eight or more, nine or more, ten or more, and the like. This composition may be in the form of a nutritional supplement or a pharmaceutical composition. In some aspects, one or more of the bacteria species or strains described herein are used to create a formulation comprising an effective amount of the composition for treating a subject. In some aspects, the effective amount is an amount effective to provide a health benefit to a subject. In some aspects, the effective amount is a therapeutically effective amount. The composition can be in any formulation known in the art. Some non-limiting examples can include topical, capsule, pill or tablet, lozenge, sachet, enema, gel, liquid, bulk powder for reconstitution or a drink prepared from bulk powder, and the like.

In various aspects, the composition comprises one or more strains or species of metabolically active, i.e., live and/or lyophilized, or non-viable, heat-killed, irradiated, or lysed probiotic bacteria, as described herein, and a physiologically, pharmaceutically, or nutritionally acceptable excipient, carrier or diluent. In some aspects, the one or more species or strains disclosed herein may be included in a food or beverage product, cosmetic, or nutritional supplement.

Nutritionally acceptable excipients, carriers or diluents include, but are not limited to, those suitable for human or animal consumption and those that are used standardly in the food or supplement industry. Typical nutritionally acceptable excipients, carriers or diluents are familiar to the skilled person in the art.

Examples of such suitable excipients for the various different compositions described herein, in some aspects, are found in the "Handbook of Pharmaceutical Excipients, 2nd Edition, (1994), Edited by A Wade and P J Weller. Acceptable carriers or diluents, in some aspects, are described, for example, in Remington's Pharmaceutical Sciences, Mack Publishing Co. (A. R. Gennaro edit. 1985). Such suitable carriers include, but are not limited to, lactose, starch, glucose, cellulose, microcrystalline cellulose, methyl cellulose, magnesium stearate, mannitol, sorbitol and the like. Such suitable diluents include, but are not limited to water, ethanol, propylene glycol, and glycerol.

In some aspects, a suitable excipient is a stabilizing excipient or cryoprotectant, which preserves viability of the bacteria. In various aspects, the terms "stabilizing excipient" and "cryoprotectant" are used interchangeably herein. In some aspects, such cryoprotectant preserves viability of the bacteria after it is lyophilized. In some aspects, a suitable cryoprotectant includes inositol, sorbitol, mannitol, trehalose, glucose, sucrose, corn syrup, DMSO, starches and/or modified starches of all types, PVP, maltose, or other mono and disaccharides. In some aspects, an effective amount of a cryoprotectant is used to minimize cell damage on freezing.

In some aspects, the cryoprotectant keeps the bacteria viable for an extended period of time. In some aspects, the bacteria survive with less than about a 1 log unit reduction in CFU, less than about a 2 log reduction in CFU, less than about a 3 log reduction in CFU, less than about a 4 log reduction in CFU, less than about a 5 log reduction in CFU, or less than about a 6 log reduction in CFU of viable bacteria over about 12 months after lyophilization in the cryoprotectant.

In various aspects, the cryoprotectant comprises a carbohydrate. In various aspects, the carbohydrate is a sugar. In some aspects, the sugar does not crystallize. In some aspects, the sugar is a monosaccharide or disaccharide including, but not limited to, sucrose, trehalose, glucose, galactose, lactose, maltose, mannose, or a sugar alcohol including, but not limited to, ethylene glycol, glycerol, erythritol, threitol, arabitol, sorbitol, mannitol, xylitol, ribitol, galactitol, fucitol, iditol, inositol, volemitol, isomalt, maltitol, lactitol, maltotritol, maltotetraitol, polyglycitol, or alonitol, or a polysaccharide (such as maltodextrin and inulin) or any combination or mixture thereof. In some aspects, the sugar or sugar alcohol is present at about 0.1% to about 25%. In some aspects, the sugar is present at about 0.1%, at about 0.2%, at about 0.3%, at about 0.4%, at about 0.5%, at about 0.6%, at about 0.7%, at about 0.8%, at about 0.9%, at about 1%, at about 2%, at about 3%, at about 4%, at about 5%, at about 6%, at about 7%, at about 8%, at about 9%, at about 10%, at about 11%, at about 12%, at about 13%, at about 14%, at about 15%, at about 16%, at about 17%, at about 18%, at about 19%, at about 20%, at about 21%, at about 22%, at about 23%, at about 24%, or at about 25%. In some aspects, the sugar is sucrose. In some aspects, the sucrose is present at about 15% to about 20%, or at about 18%, or at about 17.8%. In some aspects, the sugar is trehalose. In some aspects, the trehalose is present at about 5% to about 20%, or at about 10%. In some aspects, the sugar alcohol is sorbitol. In some aspects, sorbitol is present in the cryoprotectant at about 0.1% to about 5%. In some aspects, sorbitol is present at about 0.5% to about 1.5%.

In various aspects, the cryoprotectant comprises sodium citrate. In some aspects, the cryoprotectant comprises a sugar or sugar alcohol and sodium citrate. In some aspects, the sodium citrate is present in the cryoprotectant at about 0.1% to about 5.0%. In some aspects, the sodium citrate is present in the cryoprotectant at about 0.1%, at about 0.2%, at about 0.3%, at about 0.4%, at about 0.5%, at about 0.6%, at about 0.7%, at about 0.8%, at about 0.9%, at about 1%, at about 1.5%, at about 2%, at about 2.5%, at about 3%, at about 3.5%, at about 4%, at about 4.5%, or at about 5%.

In some aspects, the cryoprotectant comprises propyl gallate. In some aspects, the cryoprotectant comprises a sugar and/or a sugar alcohol, sodium citrate, and propyl gallate. In some aspects, propyl gallate is present in the cryoprotectant at about 0.05% to about 1.0%. In particular aspects, propyl gallate is present in the cryoprotectant at about 0.05%, at about 0.06%, at about 0.07%, at about 0.08%, at about 0.09%, at about 0.1%, at about 0.2%, at about 0.3%, at about 0.4%, at about 0.5%, at about 0.06%, at about 0.07%, at about 0.08%, at about 0.09%, or at about 1.0%.

In some aspects, the cryoprotectant comprises sodium caseinate. In some aspects, the sodium caseinate is present in the cryoprotectant at about 0.5% to about 10%. In some aspects, the sodium caseinate is present in the cryoprotectant at about 0.5%, at about 0.6%, at about 0.7%, at about 0.8%, at about 0.9%, at about 1%, at about 2%, at about 3%, at about 4%, at about 5%, at about 6%, at about 7%, at about 8%, at about 9%, or at about 10%.

In some aspects, the cryoprotectant comprises sodium glutamate. In some aspects, the sodium glutamate is present at about 1% to about 15%. In some aspects, the sodium glutamate is present at about !%, at about 2%, at about 3%, at about 4%, at about 5%, at about 6%, at about 7%, at about 8%, at about 9%, at about 10%, at about 11%, at about 12%, at about 13%, at about 14%, or at about 15%.

In some aspects, the cryoprotectant comprises cysteine. In some aspects, the cysteine is present at about 0.01% to about 2%. In some aspects, the cysteine is present at about 0.01%, at about 0.02%, at about 0.03%, at about 0.04%, at about 0.05%, at about 0.06%, at about 0.07%, at about 0.08%, at about 0.09%, at about 0.1%, at about 0.15%, at about 0.2%, at about 0.25%, at about 0.3%, at about 0.35%, at about 0.4%, at about 0.45%, at about 0.5%, at about 0.55%, at about 0.6%, at about 0.65%, at about 0.7%, at about 0.75%, at about 0.8%, at about 0.85%, at about 0.9%, at about 0.95%, at about 1.0%, at about 1.1%, at about 1.2%, at about 1.3%, at about 1.4%, at about 1.5%, at about 1.6%, at about 1.7%, at about 1.8%, at about 1.9%, or at about 2.0%.

In some aspects, the cryoprotectant comprises ascorbic acid. In some aspects, the ascorbic acid is present at about 0.005% to about 5%. In some aspects, the ascorbic acid is present at about 0.005%, at about 0.006%, at about 0.007%, at about 0.008%, at about 0.009%, at about 0.01%, at about 0.02%, at about 0.03%, at about 0.04%, at about 0.05%, at about 0.06%, at about 0.07%, at about 0.08%, at about 0.09%, at about 0.1%, at about 0.11%, at about 0.12%, at about 0.13%, at about 0.14%, at about 0.15%, at about 0.16%, at about 0.17%, at about 0.18%, at about 0.19%, at about 0.2%, at about 0.3%, at about 0.4%, at about 0.5%, at about 0.6%, at about 0.7%, at about 0.8%, at about 0.9%, at about 1%, at about 2%, at about 3%, at about 4%, or at about 5%.

In some aspects, the cryoprotectant comprises maltodextrin. In some aspects, maltodextrin is present at about 1% to about 20%. In some aspects, the maltodextrin is present at about 1%, at about 2%, at about 3%, at about 4%, at about 5%, at about 6%, at about 7%, at about 8%, at about 9%, at about 10%, at about 11%, at about 12%, at about 13%, at about 14%, at about 15%, at about 16%, at about 17%, at about 18%, at about 19%, or at about 20%.

In some aspects, the cryoprotectant comprises a combination of any one or more of sucrose, trehalose, sorbitol, propyl gallate, sodium caseinate, sodium citrate, sodium glutamate, cysteine, ascorbic acid, and/or maltodextrin.

In some aspects, the cryoprotectant comprises sucrose, propyl gallate, sodium caseinate, and sodium citrate. In some aspects, the cryoprotectant comprises sucrose, sorbitol, sodium glutamate, and sodium citrate. In some aspects, the cryoprotectant comprises trehalose, sodium glutamate, and cysteine. In some aspects, the cryoprotectant comprises trehalose, sodium glutamate, ascorbic acid, and maltodextrin.

In some aspects, the cryoprotectant comprises sucrose at about 15% to about 20%, propyl gallate at about 0.05% to about 1.0%, sodium caseinate at about 4% to about 8%, and sodium citrate at about 0.2% to about 1.0%. In some aspects, the cryoprotectant comprises sucrose at about 15% to about 20%, sorbitol at about 0.5% to about 1.5%, sodium glutamate at about 5% to about 12%, and sodium citrate at about 0.1% to about 1.5%. In some aspects, the cryoprotectant comprises trehalose at about 5% to about 20%, sodium glutamate at about 3% to about 15%, and cysteine at about 0.01% to about 1.0%. In some aspects, the cryoprotectant comprises trehalose at about 5% to about 20%, sodium glutamate at about 3% to about 15%, ascorbic acid at about 0.01% to about 2%, and maltodextrin at about 2% to about 18%.

In some aspects, the cryoprotectant further comprises corn syrup, DMSO, starches and/or modified starches of all types, and/or PVP.

The choice of pharmaceutical excipient or stabilizing excipient (cryoprotectant), carrier, or diluent is selected with regard to the intended route of administration and standard pharmaceutical or nutraceutical practice. Such compositions, in some aspects, may comprise, in addition to the excipient, carrier or diluent, additional ingredients. Such additional ingredients include, but are not limited to, any suitable binder(s), lubricant(s), suspending agent(s), coating agent(s), solubilizing agent(s), preservatives, dyes, flavoring agent(s), antioxidants, and/or suspending agents.

Examples of suitable binders include, but are not limited to, starch, gelatin, and natural sugars. Such natural sugars include, but are not limited to, glucose, anhydrous lactose, free-flow lactose, beta-lactose, corn sweeteners, and natural and/or synthetic gums, such as acacia, tragacanth or sodium alginate, carboxymethyl cellulose and polyethylene glycol. Examples of suitable lubricants include, but are not limited to, sodium oleate, sodium stearate, magnesium stearate, sodium benzoate, sodium acetate, sodium chloride and the like. Preservatives, stabilizers, dyes, and flavoring agents, in some aspects, are also provided in the composition. Examples of preservatives include, but are not limited to, sodium benzoate, sorbic acid, and esters of p-hydroxybenzoic acid. In some aspects, antioxidants and suspending agents also are present in the composition.

In some aspects, the composition includes one or more active ingredients along with a probiotic bacteria as described herein. Active ingredients can be selected from the group consisting of: antibiotics, prebiotics, probiotics, glycans (e.g., as decoys that would limit specific bacterial/viral binding to the intestinal wall), bacteriophages, microorganisms and the like. The term "prebiotic" as used herein can be a general term to refer to chemicals and/or ingredients that can affect the growth and/or activity of microorganisms in a subject or host (e.g., can allow for specific changes in the composition and/or activity in the microbiome) and can confer a health benefit on the subject. Prebiotics include, but are not limited to, complex carbohydrates, complex sugars, resistant dextrins, resistant starch, amino acids, peptides, nutritional compounds, biotin, polydextrose, fructooligosaccharide (FOS), galactooligosaccharides (GOS), inulin, lignin, psyllium, chitin, chitosan, gums (e.g. guar gum), high amylose cornstarch (HAS), cellulose, β-glucans, hemi-celluloses, lactulose, mannooligosaccharides, mannan oligosaccharides (MOS), oligofructose-enriched inulin, oligofructose, oligodextrose, tagatose, trans-galactooligosaccharide, pectin, and xylooligosaccharides (XOS). In some aspects, anti-oxidant ingredients, such as, e.g., vitamin C, are included as prebiotic substrates to act as oxygen scavengers. Prebiotic substrates, such as these, improve the colonization and survival of the bacteria in vivo. Prebiotics, in some aspects, are selectively fermented, e.g., in the colon.

In some aspects, the prebiotic is present in an amount from about 1 to about 50% by weight, with respect to the total weight of the composition. In some aspects, the prebiotic is present in an amount from about 2 to about 40% by weight. In some aspects, the prebiotic is present in an amount from about 3 to about 30% by weight. In some aspects, the prebiotic is present in an amount from about 4 to about 25% by weight. In some aspects, the prebiotic is present in an amount from about 5 to about 20% by weight. In some aspects, the prebiotic is present in an amount of about 1%, 2%, 3%, 4%, 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 35%, 40%, 45%, or 50%.

In some aspects, a prebiotic is present in a greater amount than a probiotic. In some aspects, the prebiotic:probiotic ratio is about 5,000:1, about 4,500:1, about 4,000:1, about 3,500:1, about 3,000:1, about 2,500:1, about 2,000:1, about 1,500:1, about 1,000:1, about 900:1, about 800:1, about 700:1, about 600:1, about 500:1, about 400:1, about 300:1, about 200:1, about 100:1, about 90:1, about 80:1, about 70:1, about 60:1, about 50:1, about 40:1, about 30:1, about 20:1, about 10:1, about 9:1, about 8:1, about 7:1, about 6:1, about 5:1, about 4:1, about 3:1, about 2:1, or about 1:1.

Prebiotics, in various aspects, are found in foods (e.g., acacia gum, guar seeds, brown rice, rice bran, barley hulls, chicory root, Jerusalem artichoke, dandelion greens, garlic, leek, onion, asparagus, wheat bran, oat bran, baked beans, whole wheat flour, banana), and breast milk. In some aspects, prebiotics are administered in other forms (e.g. capsule or dietary supplement).

In some aspects, a composition of the disclosure further comprises at least one additional bacteria that degrades resistant starch. In some aspects, the bacteria that degrades resistant starch is *Bifidobacterium adolescentis, Ruminococcus bromii, Bacteriodes thetaiotamicron, Bacteriodes ovatus, Bifidobacterium breve,* or *Roseburia intestinalis.*

In some aspects, the disclosure includes a composition, wherein the bacteria survive with less than about a 1 log unit reduction in CFU, less than about a 2 log reduction in CFU, less than about a 3 log reduction in CFU, less than about a 4 log reduction in CFU, less than about a 5 log reduction in CFU, or less than about a 6 log reduction in CFU of viable bacteria over about 12 months after lyophilization in the cryoprotectant.

In some aspects, the disclosure includes products, such as feedstuffs, food products, dietary supplements, nutraceuticals, nutritional formulae, drinks and/or medicaments comprising one or more bacterial species as disclosed herein, and use thereof.

In some aspects, a composition of the disclosure comprises additionally at least one other kind of other food grade bacterium. Such suitable food grade bacteria include, but are not limited to, lactic acid bacteria, bifidobacteria, propionibacteria, and/or mixtures thereof.

In one aspect, a food product of the disclosure comprises one or more of the bacterial species disclosed herein. The term "food product" is intended to cover all consumable products that can be solid, jellied or liquid. Suitable food products include, but are not limited to, functional food products, food compositions, health foods, pet foods, livestock feed, feedstuffs and the like. In some aspects, the food product is a health food.

As used herein, the term "functional food product" means food that is capable of providing not only a nutritional effect, but is also capable of delivering a further beneficial effect to the consumer. Accordingly, functional foods are ordinary foods that have components or ingredients (such as those described herein) incorporated into them that impart to the food a specific functional, e.g., medical or physiological, benefit other than a purely nutritional benefit.

Examples of specific food products include, but are not limited to, milk-based products, ready to eat desserts, powders for re-constitution with, e.g., milk or water, chocolate milk drinks, malt drinks, ready-to-eat dishes, instant dishes, and/or drinks for humans or animals, representing a complete or a partial diet. In some aspects, the food product is intended for humans, pets or livestock. In some aspects, the composition is intended for animals including, but not limited to, dogs, cats, pigs, cattle, horses, goats, sheep, and/or poultry. In a particular aspect, the food product is intended for humans. In some aspects, the food product is intended for adult humans.

In some aspects, the "milk-based product" is any liquid or semi-solid milk or whey-based product having a varying fat content. The milk-based product, in some aspects, is, e.g., cow's milk, goat's milk, sheep's milk, skimmed milk, whole milk, milk recombined from powdered milk and whey without any processing, or a processed product, such as yogurt, curdled milk, curd, sour milk, sour whole milk, butter milk and/or other sour milk products. The milk-based product includes milk beverages, such as whey beverages, fermented milks, condensed milks, infant and/or baby milks; flavored milks, ice cream; and milk-containing food, such as sweets.

In some aspects, the product is a feedstuff or animal feed comprising the bacterial species described herein.

In some aspects, the compositions described herein are food supplements, or may be added to food supplements, i.e., also referred to herein as dietary or nutritional supplements or food additives. Thus, the disclosure includes a dietary supplement or food additive comprising one or more bacterial species described herein.

The bacterial species or strains and compositions described herein are used in human and/or animal nutrition. In some aspects, the bacterial species and compositions are used in the early-weaned period and growing, fattening period. A probiotic comprising one or more bacteria as described herein are expected to enhance immune function, treat and/or prevent infectious diseases, beneficially alter the microbiota flora of the subject being treated, and improve growth and performance. In some aspects, the bacterial species and compositions comprising them provide such benefits through increased feed conversion efficiency.

In some aspects, the composition is formulated as a dietary supplement. Such a composition can be incorporated with vitamin supplements. Such a composition can be formulated in a chewable form, such as a probiotic gummy or soft chew. Such a composition can be incorporated into a form of food and/or drink. Non-limiting examples of food and drinks where the composition is incorporated include, for example, bars, shakes, juices, infant formula, beverages, frozen food products, fermented food products, and cultured dairy products such as yogurt, yogurt drink, cheese, acidophilus drinks, and kefir.

A formulation of the disclosure can be administered as part of a fecal transplant process. A formulation can be administered to a subject by a tube, for example, nasogastric tube, nasojejunal tube, nasoduodenal tube, oral gastric tube, oral jejunal tube, or oral duodenal tube. A formulation can be administered to a subject by colonoscopy, endoscopy, sigmoidoscopy, and/or enema.

In some aspects, a composition is formulated such that the one or more of the bacteria present in the composition can replicate once they are delivered to the target habitat (e.g., the gut). In one non-limiting example, the microbial composition is formulated in a pill, powder, capsule, tablet, enteric-coated dosage form or package, such that the composition has a shelf life of at least about 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, or 48 months. In some aspects, other components are added to the composition to aid in the shelf life of the composition. In some aspects, one or more bacteria may be formulated in a manner allowing survival in a non-natural environment. For example, a bacteria that is native to the gut may not survive in an oxygen-rich environment. To overcome this limitation, the bacteria may be formulated in a pill or package that can reduce or eliminate the exposure to oxygen. Other strategies to enhance the shelf-life of bacteria may include other microbes (e.g., if the bacterial consortia comprise a composition whereby one or more strains are helpful for the survival of one or more strains).

In some aspects, a composition of the disclosure is lyophilized (e.g., freeze-dried) and formulated as a powder, tablet, capsule, enteric-coated dosage form (e.g., for delivery to ileum/colon), or pill that can be administered to a subject by any suitable route. The lyophilized formulation can be mixed with a saline or other solution or solvent prior to administration.

In some aspects, the composition is formulated for oral administration, for example, as powder, tablet, capsule, enteric-coated dosage form or pill, for delivery of the contents of the formulation to the ileum and/or colon regions of a subject.

In some aspects, the composition is formulated for oral administration. In some aspects, the composition is formulated as a powder, tablet, capsule, enteric-coated dosage form or pill for oral administration. In some aspects, the composition is formulated for delivery of the bacteria to the ileum region of a subject. In some aspects, the composition is formulated for delivery of the bacteria to the colon region (e.g., upper colon) of a subject. In some aspects, the composition is formulated for delivery of the bacteria to the ileum and colon regions of a subject.

An enteric-coating can protect the contents of the oral formulation, for example, tablet or capsule, from the acidity of the stomach and provide delivery to the ileum and/or upper colon regions. Non-limiting examples of enteric coatings include pH sensitive polymers (e.g., Eudragit L 30 D-55, Eudragit S 100 or Eudragit FS30D), methyl acrylate-methacrylic acid copolymers, cellulose acetate succinate, hydroxy propyl methyl cellulose phthalate, hydroxy propyl methyl cellulose acetate succinate (e.g., hypromellose acetate succinate), polyvinyl acetate phthalate (PVAP), methyl methacrylate-methacrylic acid copolymers, shellac, cellulose acetate trimellitate, sodium alginate, zein, other polymers, fatty acids, waxes, shellac, plastics, and plant fibers. In some apects, the enteric coating is formed by a pH sensitive polymer. In some aspects, the enteric coating is formed by Eudragit L 30 D-55, Eudragit S 100 or Eudragit FS30D.

In some aspects, the enteric coating can be applied directly to the probiotic or prebiotic to protect the probiotic or prebiotic from the acidity of the stomach and provide delivery to the ileum and/or upper colon regions. For example, the probiotic or prebiotic can be encapsulated with an enteric coating that can include pH sensitive polymers (e.g., Eudragit L 30 D-55, Eudragit S 100 or Eudragit FS30D), methyl acrylate-methacrylic acid copolymers, cellulose acetate succinate, hydroxy propyl methyl cellulose phthalate, hydroxy propyl methyl cellulose acetate succinate (e.g., hypromellose acetate succinate), polyvinyl acetate phthalate (PVAP), methyl methacrylate-methacrylic acid copolymers, shellac, cellulose acetate trimellitate, sodium alginate, zein, other polymers, fatty acids, waxes, shellac, plastics, and plant fibers. In some aspects, the enteric encapsulation coating is formed by a pH sensitive polymer. In some aspects, the enteric encapsulation coating is formed by Eudragit L 30 D-55, Eudragit S 100 or Eudragit FS30D.

In some aspects, the enteric coating can be designed to dissolve at any suitable pH. In some aspects, the enteric coating is designed to dissolve at a pH greater than about pH 5.0, or at a pH greater than about pH 6.0, or at a pH greater than about pH 7.0. In some aspects, the enteric coating is designed to dissolve at a pH greater than about pH 5.0 to about pH 7.0. In some aspects, the enteric coating is designed to dissolve at a pH greater than about pH 5.0, 5.1, 5.2, 5.3, 5.4, 5.5, 5.6, 5.7, 5.8, 5.9, 6, 6.1, 6.2, 6.3, 6.4, 6.5, 6.6, 6.7, 6.8, 6.9, 7, 7.1, 7.2, 7.3, 7.4, or 7.5.

In some aspects, the administration of a composition or formulation of the disclosure is preceded by, for example, colon cleansing methods such as colon irrigation/hydrotherapy, enema, administration of laxatives, dietary supplements, dietary fiber, enzymes, and magnesium. In some aspects, the administration of a composition or formulation of the disclosure is preceded by, for example, a step of administering an antibiotic or antibiotics to reduce the existing microbiome prior to administration of the composition or formulation.

In some aspects, the bacteria are formulated as a population of spores. Spore-containing formulations can be administered by any suitable route described herein. Orally administered spore-containing formulations can survive the low pH environment of the stomach. The amount of spores employed can be, for example, from about 1% w/w to about 99% w/w of the entire formulation.

Formulations provided herein can include the addition of one or more agents to the composition in order to enhance stability and/or survival of the microbial formulation. Non-limiting example of stabilizing agents include genetic elements, glycerin, ascorbic acid, skim milk, lactose, tween, alginate, xanthan gum, carrageenan gum, mannitol, palm oil, and poly-L-lysine (POPL).

The terms "subject," "individual," "host," and "patient" are used interchangeably herein and refer to any animal subject, including humans, laboratory animals, livestock, and household pets. The subject can host a variety of microorganisms. The subject can have different microbiomes in various habitats on and in their body. The subject may be diagnosed or suspected of being at high risk for a particular disorder or disease. The subject may have a microbiome state that is contributing to a disease (a dysbiosis). In some aspects, the subject is not necessarily diagnosed or suspected of being at high risk for the disease. In some aspects, the subject may be suffering from a particular disorder or disease.

In some aspects, the disclosure provides methods for treating a subject. The terms "treatment" or "treating" are used interchangeably herein. These terms can refer to an approach for obtaining beneficial or desired results including, but not limited to, a therapeutic benefit and/or a prophylactic benefit. A therapeutic benefit, in various aspects, includes eradication or amelioration of the underlying disorder, disease, or condition being treated. Also, in some aspects, a therapeutic benefit is achieved with the eradication or amelioration of one or more of the physiological symptoms associated with the underlying disorder, disease, or condition, such that an improvement is observed in the subject, notwithstanding that the subject may still be afflicted with the underlying disorder, disease, or condition. A prophylactic effect includes delaying, preventing, or eliminating the appearance of a disorder, disease, or condition, delaying or eliminating the onset of symptoms of said disorder, disease, or condition, slowing, halting, or reversing the progression of the disorder, disease, or condition, or any combination thereof. For prophylactic benefit, a subject at risk of developing a particular disorder, disease, or condition, or to a subject reporting one or more of the physiological symptoms of a disorder, disease, or condition may undergo treatment, even though a diagnosis of the disorder, disease, or condition may not have been made.

In some aspects, the disclosure includes supplementing a subject of the disclosure. In some aspects, the compositions of the disclosure includes supplementing a person's diet with bacteria of the disclosure and compositions comprising one or more type of bacteria of the disclosure.

Altering the composition of a microbiome in a subject can have desired health consequences. In some aspects, compositions of the disclosure are administered as a therapeutic and/or a prophylactic for treating and/or preventing a disorder, disease, or condition. Treatments designed to alter the host microbiome(s) can result in a reduction of symptoms, prevention of disease, and or treatment of the disorder, disease, or condition. For example, modification of the gut microbiome can reduce the risk for health conditions, such as metabolic disorders.

The disclosure also provides methods for the restoration of a microbial habitat of a subject to a healthy state. In some aspects, the methods comprise microbiome correction and/or adjustment in a subject including, for example, replenishing native microbes, administering probiotics (including probiotic bacteria), removing pathogenic microbes, administering prebiotics, and/or administering growth factors necessary for microbiome survival. In some aspects, the methods also comprise administering antimicrobial agents, such as antibiotics, to reduce or remove harmful bacteria.

In some aspects, bacteria of the disclosure and compositions comprising one or more type of bacteria of the disclosure are used to alter the composition of a microbiome in a subject having desired health consequences. In some aspects, compositions of the disclosure are administered as a therapeutic, a prophylactic, or a nutraceutical. Treatments designed to alter the host microbiome(s) can result in a reduction of patient symptoms, prevention of disease, and or treatment of the disease, disorder, or condition. In various aspects, the terms "disease," "disorder," or "condition" are used interchangeably. Thus, in some aspects, such a "disorder" is an intestinal disorder, a metabolic disorder, an inflammatory disorder, or an immune disorder. For example, modification of the gut microbiome can reduce the risk of adverse health conditions, such as the disorder is an intestinal disorder, a metabolic disorder, an inflammatory disorder, or an immune disorder. In addition, modification of the gut microbiome can provide benefits for healthy weight, blood glucose management, and/or gastrointestinal health.

In various aspects, such a "disorder" includes, but is not limited to, insulin resistance, insulin sensitivity, pre-diabetes, diabetes or Type 2 Diabetes Mellitus (T2DM), irritable bowel syndrome, metabolism irregularity, obesity, obesity-related conditions, hypertension, stress, stress-related conditions, drug metabolism, gastrointestinal infection, Inflammatory Bowel Disease (IBD), Crohn's Disease. In some aspects, such condition is a low body weight, and the composition is used to increase body weight in such subjects. In some aspects, such condition is a high body weight, and the composition is used to decrease body weight in such subjects. In another aspect, the composition is used to maintain current body weight in a subject.

In some aspects, bacteria of the disclosure and compositions comprising one or more bacteria of the disclosure are used to help support healthy weight maintenance, help support healthy weight management, help a subject feel less hungry between meals, help maintain healthy blood sugar levels, help maintain blood sugar levels in the normal range, help support digestive/gut health and provide more good bacteria.

Butyrate is an anti-inflammatory factor that can affect gut permeability. Low levels of butyrate producing bacteria as well as reduced lactate producing bacteria correlate with diabetes, T2DM, obesity, and metabolic disorder. Thus, increasing the content of butyrate-producing bacteria in a subject is beneficial in the prevention and/or treatment of such diseases, conditions, or disorders.

The disclosure also provides methods for the restoration of a microbial habitat of a subject to a healthy state. In some aspects, such method comprises microbiome correction and/or adjustment including for example, replenishing native microbes, removing pathogenic microbes, administering prebiotics, and growth factors necessary for microbiome survival. Thus, in some aspects, the method also comprises administering antimicrobial agents, such as antibiotics.

Compositions containing bacteria described herein are administered for prophylactic and/or therapeutic treatments. In various aspects, the administration is by ingesting. In therapeutic applications, the compositions are administered to a subject already suffering from a disease, disorder, or condition, in an amount effective to cure or at least partially arrest the symptoms of the disease, disorder, or condition, or to cure, heal, improve, or ameliorate the condition. In some aspects, such compositions are administered to lessen a likelihood of developing, contracting, or worsening a condition. Amounts effective for this use can vary based on the severity and course of the disease, disorder, or condition, previous therapy, the subject's health status, weight, and response to the drugs, and the judgment of the treating physician.

In some aspects, a composition is administered (e.g., ingested) along with another therapeutic agent or active ingredient, and the composition and agent or active ingredient can be administered in any order or simultaneously. A composition, as described herein, can be administered before, during, or after the occurrence or observance of the disease, disorder, or condition, and the timing of administering the composition can vary. For example, in some aspects, the composition is used as a prophylactic and can be administered continuously to subjects with a propensity to a disease, disorder, or condition in order to lessen a likelihood of the occurrence of the disease, disorder, or condition. In some aspects, the composition is administered to a subject during or as soon as possible after the onset of the symptoms.

In some aspects, a composition is packaged as a kit. In some aspects, a kit includes written material or instructions on the administration/use of the composition. The written material, in some aspects, is a label. The written material, in some aspects, provides methods of administration, including methods of consumption.

In some aspects, a composition is administered orally, enterally or rectally. For example, the composition, in some aspects, is an edible composition. "Edible" means a material that is approved for human and/or animal consumption. In some aspects, the edible composition is present in food products or feed products as described herein.

Other suitable oral administration includes, but is not limited to, the use of compressed tablets, tablets, pills, gelules, drops, capsules, powder, liquids, solutions, and emulsions. In some aspects, encapsulated products are favored when the bacteria is an anaerobe. In some aspects, the composition is administered as part of a food or nutritional product, such as milk or a whey-based fermented dairy product, or as a pharmaceutical product.

In some aspects, suitable pharmaceutical compositions are in the form of suppositories, pessaries, suspensions, emulsions, lotions, ointments, creams, gels, sprays, solutions and/or dusting powders. In some aspects, a suitable composition is topically applied. For example, the active ingredient (e.g., one or more bacterial species of the disclosure), in some aspects, is incorporated into a cream consisting of, e.g., an aqueous emulsion of polyethylene glycols or liquid paraffin, or into an ointment consisting of a white wax or white soft paraffin base together with such stabilizers and/or preservatives as may be required.

In some aspects, a composition is formulated into unit dosage form, i.e., in the form of discrete portions containing a unit dose, or a multiple dose, or a sub-unit of a unit dose.

For example, a typical or usual suitable or effective dose in humans of the one or more bacterial species is from about $1 \times E3$ ($1 \times E3 = 1 \times 10^3 = 1 \times (10$ to the power $3$)) to about $1 \times E13$ colony forming units (CFU). In some instances, a suitable or effective dose is from about $1 \times E6$ to about $1 \times E11$ CFU. In particular instances, a suitable or effective dose is from about $1 \times E7$ to about $1 \times E10$ CFU. In some additional aspects, a suitable or effective dose of the bacterial species is about $1 \times E2$ CFU, $1 \times E3$ CFU, $1 \times E4$ CFU, $1 \times E5$ CFU, $1 \times E6$ CFU, $1 \times E7$ CFU, $1 \times E8$ CFU, $1 \times E9$ CFU, $1 \times E10$ CFU, $1 \times E11$ CFU, $1 \times E12$ CFU, $1 \times E13$ CFU, $1 \times E14$ CFU, or $1 \times E15$ CFU.

In some aspects, a composition of the disclosure is administered or consumed 1, 2, 3, 4, 5, or more times daily. In some aspects, the dose is daily, every other day, three times a week, twice a week, once a week, once every other week, or at other appropriate intervals for treatment of the condition.

Thus, in some aspects, a composition comprises one or more bacterial species and/or cellular components thereof, as active ingredients, in an amount of from about $1 \times E3$ to about $1 \times E13$ colony forming units (CFU)/gram (g), with respect to the weight of the composition. In some aspects, one or more bacterial species, and/or cellular components thereof, are present in an amount from about $1 \times E5$ to about $1 \times E11$ CFU/g. In some aspects, one or more bacterial species, and/or cellular components thereof, are present in an amount from about $1 \times E6$ to about $1 \times E10$ CFU/g. In some aspects, one or more bacterial species, and/or cellular components thereof, are present in the composition in an amount from about $1 \times E8$ to about $1 \times E10$ CFU/g. In some aspects, a composition comprises one or more bacterial species, and/or cellular components thereof, present in an amount of about $1 \times E1$ CFU/g, about $1 \times 2$ CFU/g, about $1 \times E3$ CFU/g, about $1 \times E4$ CFU/g, about $1 \times E5$ CFU/g, about $1 \times E6$ CFU/g, about $1 \times E7$ CFU/g, about $1 \times E8$ CFU/g, about $1 \times E9$ CFU/g, about $1 \times E10$ CFU/g, about $1 \times E11$ CFU/g, about $1 \times E12$ CFU/g, about $1 \times E13$ CFU/g, about $1 \times E14$ CFU/g, or about $1 \times E15$ CFU/g.

Thus, in some aspects, the dose of bacteria in the composition is about 0.1 milligrams (mg), about 0.2 mg, about 0.3 mg, about 0.4 mg, about 0.5 mg, about 0.6 mg, about 0.7 mg, about 0.8 mg, about 0.9 mg, about 1.0 mg, about 2.0 mg, about 3.0 mg, about 4.0 mg, about 5.0 mg, about 6.0 mg, about 7.0 mg, about 8.0 mg, about 9.0 mg, about 10 mg, about 15 mg, about 20 mg, about 25 mg, about 30 mg, about 35 mg, about 40 mg, about 45 mg, about 50 mg, about 55 mg, about 60 mg, about 65 mg, about 70 mg, about 75 mg, about 80 mg, about 85 mg, about 90 mg, about 95 mg, about 100 mg, about 200 mg, about 300 mg, about 400 mg, about 500 mg, about 600 mg, about 700 mg, about 800 mg, about 900 mg, or about 1 gram. In some aspects, a dose of bacteria, i.e., probiotic, in the composition ranges from about 1 mg to about 500 mg. In some aspects, a dose of probiotic ranges from about 2 mg to about 300 mg. In some aspects, a dose of probiotic ranges from about 5 to about 100 mg.

In the disclosure, the terms "comprises," "comprising," "includes," "including," "having," and their conjugates mean "including, but not limited to." The term "consisting of" means "including and limited to." The term "consisting essentially of" means that the composition, method or structure may include additional ingredients, steps and/or parts, but only if the additional ingredients, steps and/or parts do not materially alter the basic and novel characteristics of the claimed bacteria, composition, method, or use.

The disclosure is further described by way of the following non-limiting examples. It is understood that the examples, embodiments, and aspects described herein are for illustrative purposes only and that various modifications or changes in light thereof will be suggested to persons skilled in the art and are to be included within the spirit and purview of this application and scope of the appended claims. All publications, patents, and patent applications cited herein are hereby incorporated by reference in their entirety for all purposes to the extent that it is not inconsistent with the disclosure.

EXAMPLES

Additional aspects and details of the invention will be apparent from the following examples, which are intended to be illustrative rather than limiting.

Example 1: Isolation of Short Chain Fatty Acid Producing Bacteria

Experiments were carried out to isolate SCFA-producing bacteria. Fecal material was placed under anaerobic conditions shortly after a donation and processed immediately. Fecal samples from multiple donors were mixed, resuspended 1:10 in M9 minimal media ($Na_2HPO_4$ 6 g/L, $KH_2PO_4$ 3 g/L, NaCl 0.5 g/L, $NH_4Cl$ g/L, $CaCl_2$ 0.1 mM, $MgSO_4$ 1 mM) and passed through a 100 µm cell sieve to remove larger insoluble material. The samples were washed twice and resuspended in M9 minimal media to the original concentration. The slurries were then serially diluted and 100 µl of each sample were plated onto various microbial culture plates. The culture plates used were Reinforced Clostrial Agar (RCA) (Hardy Diagnostics C8721), Yeast Casitone Fatty Acid agar (YCFA) (Casitone 10 g/L, Yeast Extract 2.5 g/L, $NaHCO_3$ 4 g/L, Cysteine 1 g/L, $K_2HPO_4$ 0.45 g/L, $KH_2PO_4$ 0.45 g/L, NaCl 0.9 g/L, $(NH_4)_2SO_4$ 0.9 g/L, $MgSO_4 \cdot 7H_2O$ 0.09 g/L, $CaCl_2$ 0.09 g/L, Hemin 10 mg/L, Resazurin 1 mg/L, Biotin 10 µg/L, Cabalamin 10 µg/L, p-aminobenzoic acid 30 µL, Folic acid 50 µg/L, Pyridoxine 150 µg/L, Thiamine 50 µg/L, Riboflavin 50 µg/L, Acetic acid 1.9 ml/L, Propionic acid 0.7 ml/L, iso-Butyric acid 90 µL, n-Valeric acid 100 µl/L, iso-Valeric acid 100 µl/L), supplemented with 1% unmodified potato starch (Bob's Red Mill Natural Foods), Enriched Trypticase Soy agar (ETSA) (Anaerobe Systems AS-548), Brain Heart Infusion (BHI) (Anaerobe Systems AS-6426), MTGE (Anaerobe Systems AS-777), M17 (Difco BD 218561), supplemented with 1% unmodified potato starch. The plates were incubated for 48 hours at 37° C., under anaerobic conditions (5% $H_2$, 15% $CO_2$, 80% $N_2$).

Morphologically diverse colonies were picked from each plate and put into RCB media (AS-606, Anaerobe Systems) and modified YCFA (i.e., Yeast, Casitone, Fatty Acids) broth (Casitone 10 g/L, Yeast Extract 2.5 g/L, $NaHCO_3$ 4 g/L, Cysteine 1 g/L, $K_2HPO_4$ 0.45 g/L, $KH_2PO_4$ 0.45 g/L, NaCl 0.9 g/L, $(NH_4)_2SO_4$ 0.9 g/L, $MgSO_4 \cdot 7H_2O$ 0.09 g/L, $CaCl_2$ 0.09 g/L, Hemin 10 mg/L, Resazurin 1 mg/L, Biotin 10 µg/L, Cabalamin 10 µg/L, p-aminobenzoic acid 30 g/L, Folic acid 50 µg/L, Pyridoxine 150 µg/L. Thiamine 50 µg/L, Riboflavin 50 µg/L, 1% potato starch) in 96-deep well plates. After overnight incubation at 37° C. under anaerobic conditions, butyrate, acetate and propionate levels were measured in the supernatants from each well (see analytical method below).

Organisms from the wells positive for butyrate were isolated and identified by MALDI TOF or 16s-rRNA sequence (Accugenix, Charles River Labs, Inc.). Single bacterial colonies were lysed with 1 µl of 70% formic acid, dried, and 1 µl of matrix on a MALDI TOF plate, dried and loaded onto the instrument where they were ionized by a laser. The matrix absorbs most of the energy and transfers it to the sample. The ionized sample was broken into smaller pieces which were then pulled into a mass analyzer region and were separated based on their mass to charge ratio (m/z). Bacteria were identified by comparing their spectra to the spectra from known bacteria in the instrument's database.

Example 2: Lyophilization of Short Chain Fatty Acid Producing Bacteria

Experiments were carried out to determine how well bacteria could survive lyophilization. Bacteria were cultured by inoculating 100 ml of the appropriate bacteriological media with a single bacterial isolate followed by incubation at 37° C. under anaerobic conditions. Samples (200 µl) were collected from the culture at various time points for analysis of OD600, spotting of 10 µl onto solid bacteriological media for colony-forming unit (CFU) determination, and for aliquoting into four different lyophilization media. The lyophilization vials were flash frozen in dry ice methanol and stored at −80° C. until lyophilization. The four lyophilization media used were: media 1 (sucrose 17.8%, propyl gallate 0.2%, sodium caseinate 6.4%, sodium citrate 0.6%); media 2 (sucrose 17.5%, Sorbitol 0.9%, sodium glutamate 8.5%, sodium citrate 0.6%); media 3 (trehalose 15%, sodium glutamate 8.5%, cysteine 0.1%); and media 4 (trehalose 10%, sodium glutamate 8.5%, ascorbic acid 0.2%, maltodextrin 10%). The samples were lyophilized in a VirTis Wizard 2.0 Advantage plus lyophilizer under the conditions set out in Table 3 below.

TABLE 3

Lyophilization Conditions

| Temperature (° Celsius) | Time (min) | Vacuum (mTorr) |
|---|---|---|
| −10 | 30 | 100 |
| 0 | 120 | 100 |
| 0 | 30 | 100 |
| 10 | 600 | 100 |
| 10 | 720 | 100 |

The number of CFUs was determined before and after lyophilization to determine the number of bacteria that survived the lyophilization procedure. Samples were serially diluted and 10 µl was spotted in triplicate onto square RCB agar plates with a grid. After 24-48 hours of incubation, bacterial colonies were counted visually.

Example 3: Short Chain Fatty Acid Quantitation from Bacterial Isolates

Experiments were carried out to quantitate short chain fatty acid production in bacterial isolates. Supernatants from the bacterial isolates were diluted 20-fold with acetonitrile, and 20 µl of each of the diluted samples were mixed with 500 µl of derivatization mix (Triphenylphosphine; 2,2'-Dipyridyl Disulfide; Hydrazinoquinoline combined in equal volumes for a final concentration of 2 mM, containing the working internal standards) in a 2 ml, 96-well deep well plate and capped and heated at 65° C. for 1 hour. After incubation, the plates were removed and placed at 4° C. for 15 minutes, then vortexed gently, and centrifuged for 1 minute at 2000 rpm. Samples (150 µl from each well) were transferred to a clean 96-well plate containing 300 µl of acetonitrile per well. The derivatized samples were analyzed by High Performance Liquid Chromatography/MS/MS (AB Sciex triple Quad 4000) with a Waters Xselect HSS C18 SB 2.1×50 mm×2.5 column using 0.1% formic acid in water as mobile phase A and 0.1% formic acid in acetonitrile as mobile phase B. The internal standards were butyric acid-d7, propionic acid-d6, and acetic acid-d3. The High Performance Liquid Chromatography parameters used are set out in Table 4 below.

TABLE 4

| HPLC Parameters | | | |
|---|---|---|---|
| Flow Rate | 0.4 mL/min | | |
| Mobile Phase | Time | Mobile A | Mobile B |
| | 0 | 98% | 2% |
| | 0.01 | 98% | 2% |
| | 5 | 70% | 30% |
| | 5.01 | 5% | 95% |
| | 5.5 | 5% | 95% |
| | 5.51 | 98% | 2% |
| | 7.50 | Stop | |
| Injection volume | 1 uL | | |

The concentrations of butyric acid, propionic acid and acetic acid were determined. For example, the amounts of butyrate produced by the bacteria are provided in Table 5 below.

TABLE 5

Butyrate Production

| SEQ ID NO: | Amount of Butyrate Produced (micromoles over about 24 hours) |
|---|---|
| 1 | 19975 |
| 2 | 26217 |
| 3 | 22131 |
| 4 | 19862 |
| 5 | 19521 |
| 6 | 20543 |
| 7 | 30713 |
| 8 | 13052 |
| 9 | 22321 |
| 10 | 20996 |
| 11 | 16173 |
| 12 | 12106 |
| 13 | 22699 |
| 14 | 25026 |
| 15 | 22926 |
| 16 | 28885 |
| 17 | 26671 |
| 18 | 18613 |
| 19 | 4796 |
| 20 | 28828 |
| 21 | 32724 |
| 22 | 20656 |
| 23 | 19975 |

Example 4: Determination of Preferred Media for Bacterial Growth

Experiments were carried out to determine preferred media for bacterial growth. Single bacterial isolates were grown for 48 hours at 37° C. in an anaerobic chamber in various media, e.g., RCB (Hardy Diagnostics C8721), RCB (Anaerobe Systems (AS-606), BHI, (Anaerobe Systems AS-6426), Peptone Yeast Glucose agar (PYG) (Anaerobe Systems, AS-606), YCFA+1.0% Resistant Starch (as discussed herein above in Example 1), TSB (Difco BD 211825), MTGE (Anaerobe Systems AS-777) or GM17 (M17 media (Difco BD 218561) supplemented with 0.5% glucose). Growth was measured in a spectrophotometer ($OD_{600}$ nM) at various time points.

Example 5: Selection and Sequencing of Short Chain Fatty Acid Producing Bacteria Bacteria that were found to produce the greatest levels of SCFA and be resistant to lyophilization were isolated and the 16S-rRNA encoding gene from each of these bacteria (see Table 1) was sequenced (Charles River's Accugenix®).

Example 6: Determining Oxygen Sensitivity of Short Chain Fatty Acid Producing Bacteria Because strict anaerobic bacteria are difficult to grow in bulk outside of anaerobic conditions, the oxygen sensitivity of various bacteria were tested under various microoxic conditions. Bacteria that were found to produce the greatest levels of SCFA and be resistant to lyophilization were subject to microoxic conditions. Single bacterial isolates were grown for 24-48 h at 37° C. in a microoxic anaerobic chamber, wherein the oxygen was controlled between 50-150 ppm, and serially diluted in phosphate buffered saline. 10 µL was spotted onto an RCB agar plate for colony formation unit (CFU) determination. Immediately after spotting of plates, one plate was retained in the anaerobic chamber and the other plates were removed from the anaerobic chamber and exposed to oxygen in the ambient air. Plates exposed to oxygen in the ambient air were placed back into the anaerobic chamber after various times of oxygen exposure and incubated for 24-48 h to allow CFU development. Bacteria growth from all plates was determined by CFU formation.

Example 7: Determining Whole Genome Sequence of Short Chain Fatty Acid Producing Bacteria Bacteria that were found to produce the greatest levels of SCFA and be tolerant of lyophilization (e.g., one of the two isolates for each genus and species) were sequenced to determine their whole genome (MOgene, St. Louis, MO). The whole genome sequences of various SCFA-producing bacteria (SEQ ID NOs: 24-35) of the disclosure are provided in Table 6 below with their counterpart 16S-rRNA encoding gene sequence.

TABLE 6

Whole genomic sequences of probiotic bacteria of the disclosure

| Whole Genome SEQ ID NO: | 16S-rRNA encoding gene SEQ ID NO: | Bacteria |
|---|---|---|
| 24 | 1 | Roseburia faecis |
| 25 | 2 | Roseburia intestinalis |
| 26 | 9 | Anaerostipes hadrus |
| 27* | 4 | Clostridium innocuum |
| 28* | 6 | Clostridium butyricum |
| 29 | 10 | Coprococcus comes |
| 30 | 11 | Agathobacter rectalis |
| 31* | 13 | Butyricicoccus faecihominis |
| 32* | 15 | Anaerostipes caccae |
| 33* | 19 | Flavonifractor plautii |
| 34 | 21 | Roseburia hominis |
| 35 | 22 | Roseburia inulinivorans |

*These sequences, i.e., SEQ ID NOs: 27, 28, and 31-33, comprise a noncontiguous finished whole genome for each bacterial species of the disclosure. The genome sequences for the species marked with an asterisk were noncontiguous likely because of gaps and/or lack of confidence in assembly due to repeat regions, and the gaps are identified in the sequence in the sequence listing.

Additionally, the presence or absence of potential toxin or antibiotic resistance genes is identified in the bacteria.
Combinations
  A. A composition comprising
    (a) at least one human isolate of short chain fatty acid (SCFA)-producing bacteria or mixtures thereof, wherein the bacteria comprises a 16S ribosomal RNA (16S-rRNA) encoding gene sequence that is at least about 80% identical to any one of the nucleotide sequences of SEQ ID NOs: 1-23 or a DNA sequence that is at least about 80% identical to any one of the nucleotide sequences of SEQ ID NOs: 24-35, and (b) an excipient, carrier, and/or diluent.

B. The composition of paragraph B, wherein the bacteria is selected from the group consisting of *Agathobacter rectalis, Anaerostipes caccae, Anaerostipes hadrus, Butyricicoccus faecihominis, Clostridium butyricum, Clostridium cochlearium, Clostridium innocuum, Coprococcus comes, Flavonifactor plautii, Roseburia faecis, Roseburia hominis, Roseburia intestinalis*, and *Roseburia inulinivorans*.

C. The composition of paragraph A or B, wherein the bacteria is lyophilized.

D. The composition of any one of paragraphs A-C, wherein the excipient is a cryoprotectant.

E. The composition of paragraph D, wherein the cryoprotectant comprises a sugar or a sugar alcohol.

F. The composition of paragraph E, wherein the cryoprotectant further comprises any one or more of propyl gallate, sodium caseinate, sodium citrate, sodium glutamate, cysteine, ascorbic acid, and/or maltodextrin.

G. The composition of any one of paragraphs D-F, wherein the cryoprotectant comprises
(a) sucrose at about 1% to about 25%;
(b) trehalose at about 1% to about 25%;
(c) sorbitol at about 0.1% to about 5%;
(d) propyl gallate at about 0.05% to about 1.0%;
(e) sodium caseinate at about 0.5% to about 10%;
(f) sodium citrate at about 0.1% to about 5%;
(g) sodium glutamate at about 1% to about 15%;
(h) cysteine at about 0.01% to about 2.0%;
(i) ascorbic acid at about 0.005% to about 5.0%;
(j) maltodextrin at about 1% to about 20%; or
(k) a combination of any of any one or more of (a)-(j).

H. The composition of any one of paragraphs D-G, wherein the cryoprotectant comprises
(a) sucrose at about 15% to about 20%, propyl gallate at about 0.05% to about 1.0%, sodium caseinate at about 4% to about 8%, and sodium citrate at about 0.2% to about 1.0%;
(b) sucrose at about 15% to about 20%, sorbitol at about 0.5% to about 1.5%, sodium glutamate at about 5% to about 12%, and sodium citrate at about 0.1% to about 1.5%;
(c) trehalose at about 5% to about 20%, sodium glutamate at about 3% to about 15%, cysteine at about 0.01% to about 1.0%; or
(d) trehalose at about 5% to about 20%, sodium glutamate at about 3% to about 15%, ascorbic acid at about 0.01% to about 2%, and maltodextrin at about 2% to about 18%.

I. The composition of any one of paragraphs D-H, wherein the cryoprotectant comprises
(a) sucrose at about 17.8%, propyl gallate at about 0.2%, sodium caseinate at about 6.4%, and sodium citrate at about 0.6%;
(b) sucrose at about 17.5%, sorbitol at about 0.9%, sodium glutamate at about 8.5%, and sodium citrate at about 0.6%;
(c) trehalose at about 15%, sodium glutamate at about 8.5%, and cysteine at about 0.1%; or
(d) trehalose at about 10%, sodium glutamate at about 8.5%, ascorbic acid at about 0.2%, and maltodextrin at about 10%.

J. The composition of any one of paragraphs A-I, wherein the bacteria survive with less than about a 1 log unit reduction in CFU, less than about a 2 log reduction in CFU, less than about a 3 log reduction in CFU, less than about a 4 log reduction in CFU, less than about a 5 log reduction in CFU, or less than about a 6 log reduction in CFU of viable bacteria over about 12 months after lyophilization in the cryoprotectant.

K. The composition of any one of paragraphs A-J, wherein the composition comprises from about 1×E3 to about 1×E11 colony-forming units (CFU) of the SCFA-producing bacteria and mixtures thereof.

L. The composition of any one of paragraphs A-K, wherein the bacteria and/or mixtures thereof produce at least about 1000 micromoles of the SCFA over about 24 hours.

M. The composition of any one of paragraphs A-L, wherein the SCFA is acetate, propionate, or butyrate, or a combination thereof.

N. The composition of any one of paragraphs A-M, wherein the SCFA is butyrate.

O. The composition of any one of paragraphs A-N, wherein the composition further comprises a prebiotic and/or a resistant starch.

P. The composition of any one of paragraphs A-O, wherein the composition further comprises at least one additional bacteria that degrades resistant starch.

Q. The composition of paragraph P, wherein the bacteria that degrades resistant starch is *Bifidobacterium adolescentis, Ruminococcus bromii, Bacteriodes thetaiotamicron, Bacteriodes ovatus, Bifidobacterium breve*, or *Roseburia intestinalis*.

R. The composition of any one of paragraphs A-Q, wherein the composition is a probiotic composition.

S. A method of increasing short chain fatty acid (SCFA) in the gastrointestinal tract of a subject comprising administering to the subject an effective amount of the composition of any one of paragraphs A-R.

T. The method of paragraph S, wherein the SCFA is acetate, propionate, or butyrate, or a combination thereof.

U. The method of paragraphs S or T, wherein the SCFA is butyrate.

V. The method of any one of paragraphs S-U, wherein the subject suffers from or is at risk of suffering from a disorder.

W. The method of any one of paragraphs S-V, wherein the disorder is an intestinal disorder, a metabolic disorder, an inflammatory disorder, or an immune disorder.

X. The method of paragraphs V or W, wherein the disorder is insulin resistance, insulin sensitivity, pre-diabetes, diabetes or Type 2 Diabetes Mellitus (T2DM), irritable bowel syndrome, metabolism irregularity, obesity, obesity-related conditions, hypertension, stress, stress-related conditions, drug metabolism irregularity, gastrointestinal infection, Inflammatory Bowel Disease (IBD), or Crohn's Disease.

Y. A method for reducing or maintaining glucose level and/or body weight in a subject in need thereof comprising administering to the subject an effective amount of the composition of any one of paragraphs A-R.

Z. The method of claim Y, wherein the subject suffers from diabetes or pre-diabetes.

AA. A method for treating, ameliorating, or preventing a disorder in a subject suffering therefrom or at risk of suffering therefrom comprising administering to the subject an effective amount of the composition of any one of paragraphs A-R.

BB. The method of paragraphs AA, wherein the disorder is an intestinal disorder, a metabolic disorder, an inflammatory disorder, or an immune disorder.

CC. The method of paragraphs AA or BB, wherein the disorder is insulin resistance, insulin sensitivity, pre-diabetes, diabetes or Type 2 Diabetes Mellitus (T2DM), irritable bowel syndrome, metabolism irregularity, obesity, obesity-related conditions, hypertension, stress, stress-related conditions, drug metabolism, gastrointestinal infection, Inflammatory Bowel Disease (IBD), or Crohn's Disease.

DD. Use of a composition of any one of paragraphs A-R in the preparation of a medicament or nutritional product for treating a metabolic disorder, an immune disorder, an intestinal disorder, or an inflammatory disorder.

The disclosure has been described in terms of particular embodiments found or proposed to comprise specific modes for the practice of the methods and compositions of the invention described herein. Various modifications and variations of the described invention will be apparent to those skilled in the art without departing from the scope and spirit of the invention. Although the disclosure provides specific embodiments or aspects, it should be understood that the invention as claimed should not be unduly limited to such specific embodiments or aspects. Indeed, various modifications of the described modes for carrying out the invention that are obvious to those skilled in the relevant fields are intended to be within the scope of the following claims.

Every document cited herein, including any cross referenced or related patent or application and any patent application or patent to which this application claims priority or benefit thereof, is hereby incorporated herein by reference in its entirety unless expressly excluded or otherwise limited. The citation of any document is not an admission that it is prior art with respect to any invention disclosed or claimed herein or that it alone, or in any combination with any other reference or references, teaches, suggests or discloses any such invention. Further, to the extent that any meaning or definition of a term in this document conflicts with any meaning or definition of the same term in a document incorporated by reference, the meaning or definition assigned to that term in this document shall govern.

While particular embodiments of the present invention have been illustrated and described, it would be obvious to those skilled in the art that various other changes and modifications can be made without departing from the spirit and scope of the invention. It is therefore intended to cover in the appended claims all such changes and modifications that are within the scope of this invention.

What is claimed is:

1. A composition comprising
   (a) at least one lyophilized human isolate of short chain fatty acid (SCFA)-producing bacteria or mixtures thereof, wherein the bacteria comprises a 16S ribosomal RNA (16S-rRNA) encoding gene sequence comprising the nucleotide sequences of SEQ ID NOs: 13 or 14 or a DNA sequence comprising the nucleotide sequence of SEQ ID NO: 31, and
   (b) an excipient, carrier, and/or diluent,
   wherein the composition is in a form selected from the group consisting of a food product, a beverage product, a cosmetic, a nutritional supplement, and mixtures thereof.

2. The composition of claim 1, wherein the bacteria comprises *Butyricicoccus faecihominis*.

3. The composition of claim 1, wherein the excipient is a cryoprotectant.

4. The composition of claim 3, wherein the cryoprotectant comprises a material selected from the group consisting of sugar, sugar alcohol, and a combination thereof.

5. The composition of claim 4, wherein the cryoprotectant further comprises an additional material selected from the group consisting of propyl gallate, sodium caseinate, sodium citrate, sodium glutamate, cysteine, ascorbic acid, maltodextrin, and combinations thereof.

6. The composition of claim 3, wherein the cryoprotectant comprises
   (a) sucrose at about 1% to about 25%;
   (b) trehalose at about 1% to about 25%;
   (c) sorbitol at about 0.1% to about 5%;
   (d) propyl gallate at about 0.05% to about 1.0%;
   (e) sodium caseinate at about 0.5% to about 10%;
   (f) sodium citrate at about 0.1% to about 5%;
   (g) sodium glutamate at about 1% to about 15%;
   (h) cysteine at about 0.01% to about 2.0%;
   (i) ascorbic acid at about 0.005% to about 5.0%;
   (j) maltodextrin at about 1% to about 20%; or
   (k) a combination of any of any one or more of (a)-(j).

7. The composition of claim 3, wherein the cryoprotectant comprises
   (a) sucrose at about 15% to about 20%, propyl gallate at about 0.05% to about 1.0%, sodium caseinate at about 4% to about 8%, and sodium citrate at about 0.2% to about 1.0%;
   (b) sucrose at about 15% to about 20%, sorbitol at about 0.5% to about 1.5%, sodium glutamate at about 5% to about 12%, and sodium citrate at about 0.1% to about 1.5%;
   (c) trehalose at about 5% to about 20%, sodium glutamate at about 3% to about 15%, cysteine at about 0.01% to about 1.0%; or

SEQUENCE LISTING (35 sequences)

SEQ ID NO: 1 - DNA, 520 bp, Roseburia faecis
tggagagtttgatcctggctcaggatgaacgctggcggcgtgcttaacacatgcaagtcgaacgaagcactctatttgatttycttcggrawtgaagattttgtgactgagtggcggacgggtgagtaacgcgtgggtaacctgcctcatacagggggataacagttggaaacgactgctaataccgcataagcgcacaggatcgcatgatcyggtgygaaaaactccggtggtatgrgatggaccygcgtctgattagccagttggcagggtaacggcctaccaaagcgacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaagaatgacggtacctgactaagaagcaccggctaaatacgtgccagcagccgcggta

SEQ ID NO: 2 - DNA, 519 bp, Roseburia intestinalis
tggagagtttgatcctggctcaggatgaacgctggcggcgtgcttaacacatgcaagtcgaacgaagcrctttayttgatytcttcggartgawkrttttgtgactgagtggcggacgggtgagtaacgcgtgggtaacctgcctcatacagggggataacagttggaaacgactgctaataccgcataagcgcacagggtcrcatgrcctggtgtgaaaaactccggtggtatgagatggacccgcgtctgattagccagttggtggggtaacggcctaccaaagcgacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaagaaatgacggtacctgactaagaagcaccggctaaatacgtgccagcagccgcggta

SEQ ID NO: 3 - DNA, 519 bp, Anaerostipes hadrus
tggagagtttgatcctggctcaggatgaacgctggcggcgtgcttaacacatgcaagtcgaacgaarcwscttawytgatyttcttcggaaytgahgwtttgkwgaytgagtggcggacgggtgagtaacgcgtgggtaacctrccctgtacagggggataacagtcagaaatgactgctaatacygcataagaccacagcaccgcatggtgcaggggtaaaarctccggtggtacaggatggacccgcgtctgattagctggttggtgaggtaacggctcaccaaggcgacgatcagtagccggcttgagagagtgaacggccacattgggactgagacacggcccaaactcctacgggaggcagcagtggggaatattgcacaatgggggaaaccctgatgcagcgacgccgcgtgagtgaagaagtatctcggtatgtaaagctctatcagcagggaagaaaatgacggtacctgactaagaagccccggctaactacgtgccagcagccgcggta

SEQ ID NO: 4 - DNA, 539 bp, Clostridium innocuum
tggagagtttgatcctggctcaggatgaacgctggcggcatgcctaatacatgcaagtcgaacgaagtttckaggaagcttgcttccaaagagacttagtggcgaacgggtgagtaacacgtaggtaacctgcccatgtgtccgggataactgctggaaacggtagctaaaaccggataggtatacagagcgcatgctcagtatattaaagcgcccatcaaggcgtgaacatggatggacctgcggcgcattagctagttggtgaggtaacggcycaccaaggcgatgatgcgtagccggcctgagagggtaaacggccacattgggactgagacacggcccaaactcctacgggaggcagcagtagggaattttcgtcaatgggggaaaccctgaacgagcaatgccgcgtgagtgaagaaggtcttcggatcgtaaagctctgttgtaagtgaagaacggctcatagaggaaatgctatgggagtgacggtagcttaccagaaagccacggctaactacgtgccagcagccgcggta

SEQ ID NO: 5 - DNA, 539 bp, Clostridium innocuum
tggagagtttgatcctggctcaggatgaacgctggcggcatgcctaatacatgcaagtcgaacgaagtttcgaggaagcttgcttccaaagagacttagtggcgaacgggtgagtaacacgtaggtaacctgcccatgtgtccgggataactgctggaaacggtagctaaaaccggataggtatacagagcgcatgctcagtatattaaagcgcccatcaaggcgtgaacatggatggacctgcggcgcattagctagttggtgaggtaacggcccaccaaggcratgatgcgtagccggcctgagagggtaaacggccacattgggactgagacacggcccaaactcctacgggaggcagcagtagggaattttcgtcaatgggggaaaccctgaacgagcaatgccgcgtgagtgaagaaggtcttcggatcgtaaagctctgttgtaagtgaagaacggctcatagaggaaatgctatgggagtgacggtagcttaccagaaagccacggctaactacgtgccagcagccgcggta

SEQ ID NO: 6 - DNA, 500 bp, Clostridium butyricum
tggagagtttgatcctggctcaggacgaacgctggcggcgtgcttaacacatgcaagtcgagcgatgaagctccttcgggagtggattagcggcggacgggtgagtaacacgtgggtaacctgcctcatagaggggaatagcctttcgaaaggaagattaataccgcataagattgtagtaccgcatggtacagcaattaaaggagtaatccgctatgagatggacccgcgtcgcattagctagttggtgaggtaacggctcaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgacggtcttcggattgtaaagctctgtctttagggacgataatgacggtacctaaggaggaagccacggctaactacgtgccagcagccgcggta

SEQ ID NO: 7 - DNA, 500 bp, Clostridium butyricum; identical to SEQ ID NO: 6

SEQ ID NO: 8 - DNA, 517 bp, Coprococus comes
tggagagtttgatcctggctcaggatgaacgctggcggcgtgcttaacacatgcaagtcgaacgaagcacttawmyytgattcttcggatgaagrkdtttgtgactgagtggcggacgggtgagtaacgcgtgggtaacctgcctcatacagggggataacagttagaaatgactgctaataccgcataagaccacagrgycgcatgrctyggtgggaaaaactccggtggtatgagatggacccgcgtctgattaggtagttggtggggtaacggcctaccaagccaacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaaaatgacggtacctgactaagaagcaccggctaaatacgtgccagcagccgcggta

SEQ ID NO: 9 - DNA, 519 bp, Anaerostipes hadrus
tggagagtttgatcctggctcaggatgaacgctggcggcgtgcttaacacatgcaagtcgaacgaarcwscttawytgatyttcttcggaaytgamgwtttgkwgaytgagtggcggacgggtgagtaacgcgtgggtaacctgccctgtacagggggataacagtcagaaatgactgctaataccgcataagaccacagcaccgcatggtgcaggggtaaaaactccggtggtacaggatggacccgcgtctgattagctggttggtgaggtaacggctcaccaaggcgacgatcagtagccggcttgagagagtgaacggccacattgggactgagacacggcccaaactcctacgggaggcagcagtggggaatattgcacaatgggggaaaccctgatgcagcgacgccgcgtgagtgaagaagtatctcggtatgtaaagctctatcagcagggaagaaaatgacggtacctgactaagaagccccggctaactacgtgccagcagccgcggta

SEQ ID NO: 10 - DNA, 517 bp, Coprococus comes
tggagagtttgatcctggctcaggatgaacgctggcggcgtgcttaacacatgcaagtcgaacgaagcacttwwmyytgattcttcggatgaagrkdtttgtgactgagtggcggacgggtgagtaacgcgtgggtaacctgcctcrtacagggggataacagttagaaatgactgctaataccgcataagaccacrgagcygcatggctcrgtgggaaaaactccggtggtatgagatggacccgcgtctgattaggtagttggtggggtaacggcctaccaagccaacgatcagtagccgacctgagagggtgaccggccacattgggactgagacacggcccaaactcctacgggaggcagcagtggggaatattgcacaatgggggraaccctgatgcagcgacgccgcgtgagcgaagaagtatttcggtatgtaaagctctatcagcagggaagaaaatgacggtacctgactaagaagcaccggctaaatacgtgccagcagccgcggta

SEQ ID NO: 11 - DNA, 519 bp, Agathobacter rectalis
tggagagtttgatcctggctcaggatgaacgctggcggcgtgcttaacacatgcaagtcgaacgaagcactttatttgatttccttcgggaytgattattttgtgactgagtggcggacgggtgagtaacgcgtgggtaacctgccttgtacagggggataacagttggaaacggctgctaataccgcataagcgcacrgcatcgcatgatgcagtgtgaaaaactccggtggtataagatggacccgcgttggattagctagttggtgaggtaacggcccaccaaggcgacgatccatagccgacctgagagggtgaccggccacattgggactgagacacggcccaaactcctacgggaggcagcagtggggaatattgcacaatgggcgaaagcctgatgcagcgacgccgcgtgagcgaagaagtatttcggtatgtaaagctctatcagcagggaagataatgacggtacctgactaagaagcaccggctaaatacgtgccagcagccgcggta

SEQ ID NO: 12 - DNA, 519 bp, Agathobacter rectalis
tggagagtttgatcctggctcaggatgaacgctggcggcgtgcttaacacatgcaagtcgaacgaagcactttatttgatttccttcgggactgattattttgtgactgagtggcggacgggtgagtaacgcgtgggtaacctgccttgtacagggggataacagttggaaacggctgctaataccgcataagcgcacrgcatcgcatgrtgcagtgtgaaaaactccggtggtataagatggacccgcgttggattagctagttggtgaggtaacggcccaccaaggcgacgatccatagccgacctgagagggtgaccggccacattgggactgagacacggcccaaactcctacgggaggcagcagtggggaatattgcacaatgggcgaaagcctgatgcagcgacgccgcgtgagcgaagaagtatttcggtatgtaaagctctatcagcagggaagataatgacggtacctgactaagaagcaccggctaaatacgtgccagcagccgcggta

SEQ ID NO: 13 - DNA, 521 bp, Butyricicoccus faecihominis
tggagagtttgatcctggctcaggatgaacgctggcggcgtgcctaacacatgcaagtcgaacggaryyrttttggaaahyycttcggrrdyggaatyytyrryttagtggcggacgggtgagtaacgcgtgagcaatctgcctttaagagggggataacagtcggaaacggctgctaataccgcataaagcatyraawycgcatgwttttgatgccaaaggagcaatccgcttttagatgagctcgcgtctgattagctrgttggcggggyaacggcccaccaaggcgacgatcagtagccggactgagaggttgaacggccacattgggactgagacacggcccagactcctacgggaggcagcagtggggaatattgcgcaatgggggaaaccctgacgcagcaacgccgcgtgattgaagaaggccttcgggttgtaaagatctttaatcagggacgaaacaaatgacggtacctgaagaataagctccggctaactacgtgccagcagccgcggta

SEQ ID NO: 14 - DNA, 521 bp, Butyricicoccus faecihominis
tggagagtttgatcctggctcaggatgaacgctggcggcgtgcctaacacatgcaagtcgaacgraryyrttttggaaayyycttcggrrryggaathytyrryttagtggcggacgggtgagtaacgcgtgagcaatctgcctttaagagggggataacagtcggaaacggctgctaataccgcataaagcatyraawycgcatgwttttgatgccaaaggagcaatccgcttttagatgagctcgcgtctgattagctrgttggcggggtaacggcccaccaaggcgacgatcagtagccggactgagaggttgaacggccacattgggactgagacacggcccagactcctacgggaggcagcagtggggaatattgcgcaatgggggraaccctgacgcagcaacgccgcgtgattgaagaaggccttcgggttgtaaagatctttaatcagggacgaaacaaatgacggtacctgaagaataagctccggctaactacgtgccagcagccgcggta

SEQ ID NO: 15 - DNA, 520 bp, Anaerostipes caccae
tggagagtttgatcctggctcaggatgaacgctggcggcgtgcttaacacatgcaagtcgaacgaagcatttaggattgaagttttcggatggatttcctatatgactgagtggcggacgggtgagtaacgcgtggggaacctgccctatacagggggataacagctggaaacggctgctaataccgcataagcgcacagaatcgcatgattcagtgtgaaaagccctggcagtataggatggtcccgcgtctgattagctggttggtgaggtaacggctcaccaaggcgacgatcagtagccggcttgagagagtgaacggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaacagacggtacctgactaagaagccccggctaactacgtgccagcagccgcggta

SEQ ID NO: 16 - DNA, 519 bp, Roseburia intestinalis
tggagagtttgatcctggctcaggatgaacgctggcggcgtgcttaacacatgcaagtcgaacgaagcactytayttgatytcttcggartgawkrttttgtgactgagtggcggacgggtgagtaacgcgtgggtaacctgcctcatacagggggataacagttggaaacgactgctaataccgcataagcgcacagggtcgcatgacctggtgtgaaaaactccggtggtatgagatggacccgcgtctgattagccagttggtggggtaacggcctaccaaagcgacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaagaaatgacggtacctgactaagaagcaccggctaaatacgtgccagcagccgcggta

SEQ ID NO: 17 - DNA, 520 bp, Roseburia faecis
tggagagtttgatcctggctcaggatgaacgctggcggcgtgcttaacacatgcaagtcgaacgaagcactctatttgattttcttcggaaatgaagattttgtgactgagtggcggacgggtgagtaacgcgtgggtaacctgcctcatacagggggataacagttggaaacgactgctaataccgcataagcgcacaggatygcatgatccggtgtgaaaaactccggtggtatgrgatggacccgcgtctgattagccagttggcagggtaacggcctaccaaagcgacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaagaatgacggtacctgactaagaagcaccggctaaatacgtgccagcagccgcggta

SEQ ID NO: 18 - DNA, 502 bp, Clostridium cochlearium
tggagagtttgatcctggctcaggacgaacgctggcggcgtgcttaacacatgcaagtcgagcgatgaagcttccttcgggaagtggattagcggcggacgggtgagtaacacgtgggyaacctgcctcaaagagrggaatagccctccgaaaggaggattaataccgcataaagttagagtttcgcatgaaactttaaccaaaggagyaatcygctttgagatgggcccgcgtcccattagctagttggtarggtaatggcttaccaaggcaacgatgggtagccgacctgagagggtgatcggccacattggaactgagacacggtccagactcctacgggaggcagcagtggggaatattgcgcaatgggggaaaccctgacgcagcaacgccgcgtgggtgatgaaggttttcggatcgtaaarccctgttttctgggacgataatgacggtaccagatgaggaagccacggctaactacgtgccagcagccgcggta

SEQ ID NO: 19 - DNA, 521 bp, Flavonifractor plautii
tggagagtttgatcctggctcaggatgaacgctggcggcgtgcttaacacatgcaagtcgaacggggtgctcatgacggaggattcgtccaacggattgagttacctagtggcggacgggtgagtaacgcgtgaggaacctgccttggagaggggaataacactccgaaaggagtgctaataccgcatgatgcagttgggtcgcatggctctgactgccaaagatttatcgctctgagatggcctcgcgtctgattagctagtaggcggggtaacggcccacctaggcgacgatcagtagccggactgagaggttgaccggccacattgggactgagacacggcccagactcctacgggaggcagcagtggggaatattgggcaatgggcgcaagcctgacccagcaacgccgcgtgaaggaagaaggctttcgggttgtaaacttcttttgtcggggacgaaacaaatgacggtacccgacgaataagccacggctaactacgtgccagcagccgcggta

SEQ ID NO: 20 - DNA, 520 bp, Roseburia faecis; identical to SEQ ID NO: 17

SEQ ID NO: 21 - DNA, 518 bp, Roseburia hominis
tggagagtttgatcctggctcaggatgaacgctggcggcgtgcttaacacatgcaagtcgaacgaagcactttaattgatttcttcggaatgaagtttttgtgactgagtggcggacgggtgagtaacgcgtgggtaacctgcctcatacagggggataacagttggaaacgactgctaataccgcataagcgcacrggattgcatgatccagtgtgaaaaactccggtggtatgagatggacccgcgtctgattagccagttggcggggtaacggcccaccaaagcgacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcrgcagggaagaagaatgacggtacctgactaagaagcaccggctaaatacgtgccagcagccgcggta

SEQ ID NO: 22 - DNA, 519 bp, Roseburia inulinivorans
tggagagtttgatcctggctcaggatgaacgctggcggcgtgcttaacacatgcaagtcgaacgaagcactttdayhgatttcttcggawwgaarttttagtgactgagtggcggacgggtgagtaacgcgtgggtaacctgcctcacacagggggataacagwtggaaacggctgctaataccgcataagcgcacartaccgcatggtacagtgtgaaaaactccggtggtgtgagatggacccgcgtctgattagctagttggcagggcarcggcctaccaaggcgacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaagaaatgacggtacctgactaagaagcaccggctaaatacgtgccagcagccgcggta

SEQ ID NO: 23 - DNA, 520 bp, Roseburia faecis
tggagagtttgatcctggctcaggatgaacgctggcggcgtgcttaacacatgcaagtcgaacgaagcactctatttgattttcttcggaaatgaagattttgtgactgagtggcggacgggtgagtaacgcgtgggtaacctgcctcatacagggggataacagttggaaacgactgctaataccgcataagcgcacaggatygcatgatcyggtgtgaaaaactccggtggtatgggatggacccgcgtctgattagccagttggcagggtaacggcctaccaaagcgacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaagaatgacggtacctgactaagaagcaccggctaaatacgtgccagcagccgcggta

SEQ ID NO: 24 - DNA, 3497674 bp, Roseburia faecis (residues 1-1,748,837 of 3,497,674)
tcctaaactgatcgagcgtgaatctactgcgcgctgtgcgcaccgcgactgacaatattttttattttatccgcataatcgcttatgctttatgcgcattctttttaagattttccaacaataccttatttcattttttaataatctgcacaaaaaaagaccgacacaatgtcggtcttaaaagaatgggcagaggtggattcgaaccaccgaagcaatttgcagcagatttacagtctgtcccctttggccactcgggaatctgcccatttccatcagaatgcgaagcactctgacaattcagaattatagcataatttttattctgtgacaagtcttttttcttttattatttatccagtgccaccgagtcccagccgtaatctttgtaatattggatgtccagatgattctgctttacataatcacgaagcatttttatacgaatttttttatgtgcctccgcggtatccatcagtttctgcggatctacctgatatccttcgcagaattcacgaatacttgtgccatagtaagatccgtcctgtgccacttttttatccttaaaaatataactgccatttccatacgaaacaaaatgtaaccgtgcaggcatttcacttccactgtcactcatcagcgtatttccgttccggtagtatgtttcccaccagaaatttccaaaaataaacagatcatttccggttctgactgttttcacaatgaccggctccggcacataaatataaattccaccgttttccagatattcatactcgtttctgtttttaatcatgtaatcacagacaagtttcataatttcatggtctccctgataagcaaattccggcagtcctgtatgctgcgtattctcttccgtcgcagtttccgtctgtatctcatcagaatgcgtctgtaccaaaagcttttccttcgaaattttctccgtgtcatccgccgggcaggaatacagttcataatcatctccaccgataataactaaagcactgcggtactgtctgccagccctatccgtccatacaatacactgctgactgtaaacgcccgtttctttcccatctttaccggaatttatcagactgttccagtagtccccgtctgccataccagaaaatgtgtccagggaattttctgcggaaaacgttttccactcccggtaaaccagttccagttttcgaacgtcctccgtcacggaaagcgcggatgatacatcagtctttttaagatcatacacatacatctgcgttggctgctgttccttcttctcattaaaaatatatatcgtgtctttctgcagcagcacacgggtatggatactgtcggtattaaaataattgcagtccattgcctgcagatccagtgccgccagaagctttttttcctgccgtccatataccatcagtgcgcgttcattggcaaataccacatatttttcagaacatcctgccagttccggtgcatacacttcatttttcagcttcaatccttcgtctgccgctttcttctgctgtaccggaagtccgcaaaattcccggatagaatcaaacaatgcgccatccgttgcggcattgacacctacgccggtcaacaggcagactgcaatcacacaggttccggccaatgccgctgcaaatgttttccggccatgcggctgccacccggatcgtatggcctgcttccacttctgtcctcttcctgaaattgtactctgaagccggttccacatctgctctttccgttcctgatccggtgacgtctgatcaatcgtatatttgaaaatttcttcccatttttcaggatcactcatcattttattttccctccctttcccaatttttcggaatctcccctgcttttttgagctcttctttcaatttcctgcgtcctgcagcaagctgcgtctgcaatgtactttcttttcgtttcagaatcgcagtcagttcccgtatggaatagccttcataataatacagatacagcagaatccggtattttggttccagcgactccagtgccagccacacaacattttccatatggttttccgatgcaatacccggttccggcatctcttcgagtgtaccgcaatgtttccgctcataactttttagtacatctttgcactgatttttcgttgcggtcagaatccatgccgtttcatgatctgtgtcccggaaacttatttttttctcccagactttcagaaataccatctgtaccatgtcttcagcatcactttggctgcccagcataaccagcgccagtctataaacacgattcacctgtcggttatataatgcctgaaaatcttccattggagtgtcatttgtttttttcatgcctgccctcctgtttccaactattatatacacgattcatcatggggaaatatctttcagaataaaatttttgaataatttcagataataaaaaagacagcttcgaacgctgccttttaggagaaggtatttttactatggggtatagcaaaaactatatataatgtattggggggtttttacggttattataatagcatgaacccctgcgaaagtgtgcacaaacctcacaaaaagtatgactcgtttttggttattttgtataagtgaaaacaaaataaaaaagacagcttcgaacgctgtctttttaggagaaggtatttttactatggggtatagcaaaaactatataatgtattggggggtttttacggttattataataccatggacggccggataagtgtgcacaaagtcgaaaaaagttcctgcgtttttctggtcagttctacggtactatattcccagttttaagaaaaaatacgaaaaattgcacaaacgcgcaaccgtttattcctgttttttgcacatgtgtttcctgtgggttattttcatacccaatttgcatcctttcccgaatgtggtcgtacacgatgcactttataaaataaaaaagacagcttcgaacgctgcctttttaggagaaggtatttttactatggggtatagcaaaaactatataatgtattggggggtttttacagttattataataccatggacggccggataagtgtgcacaaagtcgaaaaaagttcctgcgtttttctggtcagttctacggtactatattcctagttttgagaaaaaatacgaaaaattgcacaaacgcgcaaccgtttattctcattttttgcacatctactttttatttggaaatatacaattagcaaacaccctgagcaaacatagcatcttctgaggtgtccgcagatttactggggttttgaggtcggttatatatcacgtgtatagattgattgtcggacaatttcaattaacaactatttttaaaatcaatacttttcaaaagcatatcaattattaaaaaagaacatcgttcattctttactctttatgaacatatcatctattttattcatttcctcacaaaacatcctaattcattatctgtaggttctttcgtaaaacaagctttaattctccgtttctccaactctttttttaattcttgtataattgtagtctttcctgccccattaggaccatcaacagctatcaattttccactataaagatttttgttcataaaatccccctcttcacatcaaagaaatatcttcgtaatatcctgatatcgatttaccactcggtaaatctccacatattcttccccaatcttatatagcacgacataattcccgcaaatcacatatttataatccgttcggaagctgacccttttagcaagatcagctcccatgtacggaaattgctgtatattttcaattcgatcatatatctcctgaatggtctttaccgccatttcttcattatcttcagcaatatactctctaatattcttcaagtcctctgccacaatagggttaatccgcaatttcatcatatactataccccgacagatttctttagttcatccaaactcatccaggcactttcatccctaacagcttcttctgcttcctgtagtttcatgagtagcttcttttctgctttttcacgctcgtagtcctcaatatccataaccacaaacttacctctaccgtttttggtcaaaaacacgggttctccaatctggcaatttttcaacacttcattataatttctcaaatctgataccggtaatatatttggcataaaatcaacttcctttcctactacaatatagcttcttcacttatatattatacgcaggaaagctgtaaaattcaacgtgaaattttacagctttcttaccaaacgttttgcaacatctatttccaatccatcgaatcttaattctgttcttgcattttctaccacctgaaatgccttcgttcctgtactgatataagaaactatatggtttagtatttcttcctcgctgtcttcaaatgtcagtattaacattttcccatatatgtacctcacactaacatttttcaaataacgtttaacttctgaaccttgaattttcaagcgactcagaaaatagcctatcttacaaaacctttttttcgtgcataatctccaattataaaagcaactgatactatcaacaggataaatacggataatatatcccaaacatcaatcacaggttctccaattaattttgataatgtaatatttatcaaaagtgtgaacggaattgcaaacaaaaatgtaattcctgttgccaacagttttcgttccttgagtcgataatacagaatataaattatccacaaaaaaactagtgtataaatggacataatcgcaccaatgttgaatacttcattgacttttatcaaaatacttaatatgtacataaatggtaaaatgagaatactaatggcaaccatcgctaccaaaacaccttttttccccaacaatataacaggaaaagatgctatccatgtaatcaaaatagaactaagtgtaataagtgaccatgtaagggtgcccgaaatagcaacatcacatatacaacatactagaataccaataaccatggtaattgtatatattattgatattatagtattcttgttcatattattctcatcttttcgttttaattcaatgagattttcgctgactttttcttcgtaattattcatttctatcctctccccacttaatagttcattgaccgtaacatctaagatattgcaaagttccaacatgatagatgaatcggtcatacattttcctgtctcccatttggaaacagctctgtcagtgatgtttaacttttctgctaattgtgcttgtgtcagacctttttcttttctgcaactagcaataaactttcctgtatcaatttgattcattacaatatgcctcctttcacgctacactttacaatttttatcagtttttgtacacaaactgtaagtggaattatcaaactcaaccataggttgggagaggtattatatttgataaatgccgttttcttcaacaacaccattttaccacacgtgcacacacaattccattaaaaccgtttacttcgctttaaccgatacttcccatttattcctaatgagaatggagatttaatgcaatattgcgaatgcaccaatgattttgtgaatgcaatcattgatgactatttcaattcctttgaaatacgcaaatactacattaacaaatatgaacagccttattacgctgtccgtatctcgaaacttgtggaagacgataccgagaaggtcaagcgaaaatacacctacctggcttacttcgccaaaccggaaatggcttacacctatcttgctgaatacaatagcggtgcggttgttccggaacatatgaaatactcggactctcctacttttgcagagatgtacgagaaatggaagaaataccgaaaatcgcttaagaaccagattagcgattccacatggcgaaattatgagattgcttttcatcatttcagcgagctgcatgaccgcaaatttatttccatcaggacaaatgatctgcaacaatgcttaaatgcctacaatcacaaatggcagacacacctttgcttcactcatggacaatgccggagcaaatgatgtatgtatcaaattgattatgggacacagtatgaagaacgacaccaccaaaggaacatacacccataagactttagaagaacttcttacagaagtgaacaagatataaaacaataaatcaagactgattgctggatacacttatgatatttcttttatttaacgtcacacttatgttcagcctaaatcatcttgaaaagcaaaggatgaaatgcttccaaaagcattcaaaatcagtaaaaacgagtgtataccacctgtaaatcacttgtgtaccgcgtgtatatcacgacctcaaaataacgtaaattatcttctatttatgaatattctgacaatttgcatgtcttatcaatatataaagaaaagtcccataaacaccagtcaaatcgaagatttgatttgtttacaggacttctcaatatagtcttttatcttagaaattcttaattagcaaacaccctgagctaacatagcatctactaccttctcaaatccggcaatattagcacctgccacatagtctgtctttccaccaacggttgcattgtatctcttagcagcatcgctgatgttagcataaatagtctccatgattcccttaagctttccgtcaacttcttcgaatgtccaggaaagtctctcagagttctggctcatctcaagtgcagatgtagcaacaccaccggcattggcagccttaccacctacgaagagaacaccattctcctgaagatactttgtagcctcaagagttgtaggcatgttagcaccctctgttacagatgtaacaccgttagcaacgagcatcttggcatcctcaatgtctaactcattctgagtcgcacatggaagggcaagatctaccttgtactgccatacaccgtgctcaccgttctgctttgcatgatactcagccgttgacttagcagctgcatactcagtaagacgggcacgcttaacttccttaacttccttaagaagagcaacatcaattccgtttggatcataaatccatccggtagaatcagaacatgttacaaccttaacacctaactcctgtgccttctcgattgcgtagatagcaacgttaccagatccggaaactgctgctgtctttccctcaaggctcataccatgatctttccataatgcgttagtaagatataacagaccatatccggtagcctgtgtacgtgcaagagatccaccataggtaagacccttaccagtcagcacaccttcgtatgatccacgaattctcttatactgtccaaataagaagccgatctctcttgcacctgttccgatatctccggccggtacgtcaacgtctgctccgatatatttgcaaagttctgtcatgaagctctggcagaatgccatgatctctctgtcagatttacccttaggatcgaaatcagaaccacctttaccaccaccgattggaagtgttgtaagagaattcttaaatacctgctcgaaacctaagaacttgataatacccaggtttacagaaggatgaagtcttaaacctcccttgtatggtccaatggaattattgaactgtacacggaaacctctgtttacctgaacctgtccgttgtcatctacccaaggaacacggaacatgatctgacgatctggctctgtgattctctcaagaatcgcattctttctgtataattcctcatttgcatcgatcacaggtcttaaagaatcaagaacctctgttactgcctgtaagaactcaggctgatctgcgtttttcttctttactacttcgagtacttcatcaacataacccatttttctatctccttaatattaatttttaacgtccggaaccagtaaaatcccgaatcgtcatgttctgatcataatctgttgcctgtttctacaacaaccttttttattgtaacgaaaaatgcaggattttgcaatagaaaattctttattattgtaattttctaccactacggcgtaataaagcagctttttgagtacaaaatgaaacagagcgattcaaaacttgcattctgaaccgcccggttataacactaaataagtatatattttatttatccctgcttattttcgaccagtcaacgaattcggattcctcgtccgtatcatagtaggtcagtttaaagtaatccaccagttttgccaaggcaaagacaagtatctctttttcggaatcgttcatctcatccgcaacatttttaatcatctggcggtgaaactgttcgtgatgataataggcagctttccctttatctgtcaggcgcagctttattactcttttatcccgcgtactccgttcccggacaacatatcctttctcacacaaggcatccattgctttcgtgagtgtgcctgttgtaacggacatcagttttgcaacggttttcatatttcgcggctcatcaattcccactgcctcgataatatgcatatcattataactgatatctttaaactcttctgtgatcaggcttttcgcctcaatctccagaatatccttgaataattttacaagaagatcatttaatgtctcttccagcgtcatgttaaactccttcatgatctggtgtgacctaccactcgactgcacatgccccccaggtaagtccggcaccaaatccagctaatacgattttatcgcccccgcttatcataccatgtttgtggacattatcaagtaaaataggtacgcttgcggccgaaacatttccacacttctgtaaattacatgggaatttttccattggctgatgcagacgctttgccactgactcaataatccggatatttgcctggtgaagcagaaaatattttacatcttcaattggaagttctgcctgttcaagtgcttcactgaccgcctttggaaccgtgcgcacggcaaacttataaacctctctcccatccatctgggtgaacgcataatgctgtgcaccaagctggcggtaaagattattcaccggacggttctcacaatgcagtgccatgccaccggctccgtctgatccctgcaccatggaaagcagctggcttccttctgcactaactacagcagctccggctccatccccgaaaagcacacaggtactgcggtccgcccagttcatcatttttgacagggtttccgccccgataaccagtgcatgtttgtaacgtccggtacggaaataggcatccgccgtagccagtgcaaataaaaatccggaacatcccgcactcagatcaaatgccgttgcactttttgctccaattgcagcctgtacttcacacgccagcgatggaaatatgtaatccggggaaatggttcccgcgataatcagatcaatttcacatccggatatttttgcatctgcaagtgctttctctgccgcctctaccgccatggaagttgttgtctcttccactgcaatatggcgcatgccaatcccggtgcgggaacgaatccactcatctgaagtgtccataacctgagccaggtcatcattgcttacaacctttttcggaagcgcacttccggttcctaaaaatttcattttatgattctcctctatggaacaattagaactttctgaagcgatcataccgctcctgtgcaagctgcttaccactcttgtcattctgtgcacgtaaaaattctttcatatttcctttcatccatgccgcaattgaagtcagagcatcgtcatccgctccgccatactccggaatcaccttatccacaacagacagttctttcagatcctgtgccgtgatcttcatgacagttgccgcttcttttgcacgttttccatccttccagagaatggaagcaaatccctccggagaaagaatcgaataggtggcattttccatcatccatacttcattaccaaccgcaagggcaagagctccaccactgccgccttcgccaatcatcaggcaaagaatcggcacctggattccggacatttcataaaggtttcttgcaattgcctcaccctgtccgttctcctcggcttcttttcccggatatgcgccggatgtatttacaaaagtaatgattggccgattgaatttttctgcctgcttcatcagacggattgctttgcggtacccttccggcgaaggcataccaaagttgcgttccttgcagtcctttaaatcttttcccttatgcaccccgatcacggttaccggctgtccatccagataggcaataccaccgacaattgccggatcatcacggaaataacggtctccgtgcagttccatgaattcatcaaaaatctgtcccatatagtcgacagatgccagacgcttcatctgacgtgccgccatcactttatcccacggttctaacggtctggaaaacgtatttctctcgcgcatcagttcggtcggctcataacggtcatcatcatgtgcaggatcaaaatttgcatagccttcgaccggacgatgcagacgaaggatttttcctagcgtatcttttaattcgtcacgttctacaattgcatccacaaatccgtgtttcagctgaaactccgctctctggaatccatccggaagcttctccccgatggtctgctcaatcacacgcggaccggcaaaaccaatcagcgctcccggctctgcaaggataatatctccaagcattgcaaaacttgcggtcacaccaccggttgtcggatcggtcagaaccggaatataaagaagacctgcatctgaatgacgttttacagctgcagaagtctttgccatctgcatcagggaaataattccctcctgcatacgtgcaccaccggaacagcagaataagatcaccggaagtttctgttccgttgccttttccattgcacgtgtaattcgctcaccgacaacgtgccccatacttcccatcatgaaacgggcatcaatcacaccgagaactgtcttctctccgttgattgtacaacttcccatggttacgccttcgtttaatccggttttttcctgtgttgcagcaactttttcttcgtattccgggaaattcagcggattttcggtcttaagatcattatcccaggtttcaaaagttcctgcatccgccaccatacgaatacggtttttggtgcggacacggaaataatatccgcactcatagcagacatatttatttttaatgacacgctgtttatccagttcttttttgcagattttacaggtaacggtctctacaacaggtgctgcttcctttgcctcttcctgctttggctcttctgcctgtgttttttctggttcttcgttgtgatttactttgatatattttttattaaaaaacattgcctttcccctatccgattgcaaatgtcaattctgcggaacatgccagttttccatttacttttgctgttgcctgccccacaccgatcggtcccttcaccttgataatttcggtttcaagcaccagagtatcccctggaacaactttctgcttgaattttgctttattgattcctgcaaaatatgccgtctttcctttccattccggctgcgaaagaattgcaaccgcaccggtctgtgccagtgcttccacgatcagcacgcccggcataaccggatttcccggaaaatgaccggcaaaaaacggttcattgaaagttacatttttctttgctaccgcgcgcacgcccggctccacttcttccactgtgtcaatcagcagaaacggatgtctgtgtggcagaatttccataatttcctgtgttgtcatactcatagcttctactcctcgtatttgcgaaccagaagacttgcgttatgtccgccaaatccaagagagtttgacagtgcataggtaaatgactcgtgggattcttctttacagtagttcagatccatctcgtcatccggtgtctcataaccaactgtacggtgaatgtatccttcttccagctctttgacacaggtgataaattcaaccgcacctgcggcaccaagaagatgaccgatcatggactttgtagaattgatcttaatgtcctttgcatgatccccaaacagtaacttaatggcacgggtctcaaaaagatcgttgtgatgcgttgcagtaccatgcgcattgatgtacgtgatctcgtttttgtctacccccgcatcctcgatggcattctgcatagcgcgtgctgcacctgcaccgtcttcgagtggggaagtaatatggtaagcatctgcagaacatccatatcccacaacttctgcatagatttttgcgcctcttgccttcgcatgctcaagttcctcaagaacaacaatgccggcaccttcacccaatacaaaaccgctgcggtttttatcgaaaggaagggaacatttttccggatcatcggatggagaaagcgccgtcagtgcaccgaatccggcaatcgcacatggacatacggctgcctctgttcctccggctaccatgacatctgcctctccgtactgaatgctgcggaacgcatcaccgatattattcgtaccggtcgcacaggcagttacatcattggtacattttccctgcaatcccagctggatggagacatttcctgctgccatgtttgagatcatcaatggaacgaaaatcggattgactctgcccggtcctttttccacaatctttgtatactcacgctcgattgcctgaagacttccaacaccgcatccaacggctgtaccgcaacggtaagcgtcctctttttccatatcaagccctgcatccgcaacggcttctttggctgctgctactgcgtactgtgcaaacagttccatacgctttgctgccttaaaatccatatgctcttttccgacaaaacctttgacttctgccgcaagatgtgctttatattcacttgcatcaaacttcgtgataggaccaaatccaatctgtccggcatggattcctttccagaattcttccacattcaggccgatcggcgtgattgctcccattcccgtcacaacgactcttctcattttccttttcctttctttctatcaggttccttaaatggccataccaccgtctacggaaagtatctgtccggtaatataatccgactccggtgatgcaagaaatgcgactgcattcgcaatatcctgtacctgtccggctctgccaagcgggatctgcttttttaattcttcctgggtcttttccggcaatactgcggtcatctctgtctctacaaatccgggagcaaccgcattgacgcagattcctctggatgcaagctcccttgcaacagattttgtcagaccgatcacgcccgccttgctggctgcatagtttgactgtcccgcatttccaaggattccggataccgaagaaatattgataatttttccggcacgctgttttaacagatagcgtgacagatgacgaattgtattgaaagttcccttcaggttggtattgatcacagcatcaaaatcgctttccttcatgcgcatcagcagatcatcccttgtaattccggcattgttcaccagaatatccatatgcttatattctttgataagggattcaatcatctcctgacatgctgtaaaatcagagacattgcagcgaacactcacggcatctcctccggccgctttgatcgctgcaaccgtttcatttgcagcatcttcggaaccattgtagttcaccacaacaaatgctccgcgttttgccagctccagcgcaatggctcttccgattcccctggaagcacctgtaacaagtgcatttttaccggttaacatatttattgaaatcctccattttgtcgatgttgtatgtggtaacatcgcgattgatctttctcataaatccggaaaggctgcgtcccggtccgatctccacaaattcctctgctccgtctgcaatcaggcgctcaattgtctgctgccagcgcacggaagaagaaacctgacttaccagataatccttgacgtctgccggatctttgacataatctgcagtcacattggtcagatacggaatggtgatcggctgaatcgttacatcttccagtgcctctttaagtttctttcctgcttctgctaaaagtgcagaatggaacgggccactgactttaagcggaaccacgcgctttgctccggcttccttgcaggcatctcctgcctcacctacagcatctgctgctccggtgataacgatctgtcccggacagttgtaatttgcaatggaaacaactttgtttgtttttgcagcggtttcctcacagattgctgcgatcttttccgcatccagtccaagaattgcagacataccgccgcctaccggatatgcctgttccatataaataccgcgcttgcggacaaccgcaaatgcatccctcatcgtcatcgctccggatgcaatcagcgcaccatattcgccaaggcttaagcccgccgtaacgtcgcagccaattcccgctgcttttaatgctgtataaatagccgcctcggttgtgagcatacagatctgtgtgtactctgtaatgttcagcttatcattttcttcaaagcaaagagctgccacatccagacctgtcacttcatttgccagatcatagaccgcttttgcttccggcatggcgtcgtaaaactcttttcccataccaatatactgagatccctgtccagggaacataaatactctcttcactgtcttctcctatttctgtcccaataacttttcggcaccactcataacatcccggataatttccgcacaggtctcttctttttttaccagacccgcagactggcctgccataacgctgccgtacatgacatcgccctcgacaactgctttgcgcagtgctccgagtgtcatctgctcaagttcttcgaacggtgcaccttctttttctttctttaagtactcgcgggtcattttgttacgaataacgcgaatcggatggcctgtggacatgccggtcacttcactgtcaatatcttttgctttgaccacgcgctgcttgtaattttcatgaaccgtggattcttttgcaacaacaaaacgggttcccatctgtactgcctctgcgccaagcatcatagctgccgcaaatccacgtccatctgcaattccaccggctgcaatgaccggaatggataccgcatctactacctgtggtacgagtgtcatcgtcgtctgggcaccgatgtgtccaccggactccattccctcagcgaccagtgcatccgcaccgccacgctccatcagctttgccaatgccacgcttgccacaaccgggattactttgattttggcttctttccacatgctcatatatttggccggattgccggcgccggttgttactaccttaacgccttcctccacaattacttttgcaatctcatccgcttccggattcatcagcatgagatttactccaaacggcttgtcggtttctttttttgctgcctgaatctgctcacgcacccaggaagccggtgctccacctgctccgatgatgccaagtccgccggcattggataccgcactggccagttcatgtgttgcgacccatgccataccgccctgaatgatcggatattcgattcccagaagctctgtcactcttgttttcatagcttatgcctcaacacccttatttttcatataatcaatgacatcctgaacggtaaggatcttctctaaatcctcagaaggaatctctacaccgtactcttcttccaaagccataaccagctcaaacagatctaaggaatctgcctcaagatcctctttgaagcgggactctgcggtgatagaatctgcgtctacgtttaactggtctgcaatgatttcttttaacttttctaacataatgggttctccttttactgtcttcaattttgtttgattgtgaaatagtttgattgtcaaacagtttcttagtcaaagtatatgcaaagatagtttgattgtcaagatattttttcaacagggtaatgataaaagagtacaaaaaagcacagcaaacactttcttcctacacgaaaatgtctgctgtgcatatggttctgttttttgaacttatccgataatgagttgcattgccccgtatattccggcatcattgccaagctgtgccagttcaaagcgggtatcacgacatgcatggaagcagctttccttaaagtgcttctggatcgtatcgattaaaatctgtccggctttggacacaccaccaccgatcacgataacttccggattggtcacgcatgcaatattcgaaagggttgaccctaaaatttctcccacttcatctaccagtccaagagctacttcatcgccttcttttgccacatcaaaaatgtcttttgcagtaatatctttataatcacgaagctttgtcgcatcctgtgttttggcaagtttacgttttgccatgcgtacaataccggtcgcagaagtatactgttccagacatccatactgcccacagttacaaggctctatctcatcatgatttacggtaatgtgtccgatttctccgcctgcaccgttatatccggcaaccacatgtccgtccacgataattccaccgccgacaccggtaccaagcgttaccatgatgacatctttacttccttttccaccgccctgccacatttcgccaagacctgcaacgttcgcatcatttccgacttttactttcagacctgtctgtgcaccgagttcctccgcaacattgatcactccccagccgagattgacacacccgttaacaacgccatcactccgcacaggacccggaacaccgattcccacaccctctacatcactcttactgatgccttcctgcgccagtttgttatcaatcgcctgtgcaatatccggcagtactgcctttccgttatcgctggtatctgtcttgatttcccatttgtcaagaagctctccgcttgtctcaaaaaatcccatttttacggtggttcctcccacgtctacgccaaatccatatttcttcaattcctgattcctccttgatctatgtgatatgtatttttcttctaccccatgtatctatattctaccatattccggaatttctgcctagtatcgataaaaaaaatcaaccgatgtatccataaatacaccggttgcactgttttatatatgtttattgtacgtttccaccaccggtatctccactctctccggtatcaccgctattatccgtggttccgctattgtccggtttattggtattttctccattttccggcgtatcagtgtttcctccgctttctccggaatcgttgtccccactatgttccggtttggaattgttattctgatcaccggcattgctgtcgttattgtccggctggttatcattttcggagcttccgtccgttgtattatctttctgctggctctcggaagtctgctggtcatccgtctggttttcttccatctggttttcttcgcgcatcttgtcgtgttcttcctcttcctgcttctgctgatttttaaaatcatccgaaagctgagcataaggaaggaaatcaagcgaagataatccctcgtgggccgcagacatatatgctttccagatctgtgccggatatgtgcttccactcagattggaaatggcttttggataatcacatcccacccagactgcggttgtataatatctggtaaatccgcagaaccatccatctttgtgatcgtttgttgtacccgtctttccggcacacggcatatcggcaagttttgcagaacgtccggttccactgtccataacggaggtcatgatatccgtcatcatccgcgccgcatcctgcttataaaccgttttttccgtcaggctggacgtatagactacattttcgtcagaatccacaattgattttacacaggtcggttccctgtaaagtccgtcattttcaaccgctgcatacccggatgccatctcaagtggagaaacacctttggtaaatccaccaagagatgtggcgagggtataatctccgtccttgatctgtgcaaaattcatattttttaaatactgcaggcctgcttttggtgtcagttcatcatacagctgccaggcaatcgtattaatggaatgtgcaaccgcatatctgagcggaatctttccggcatatgtattgtttgcatttgacggtccgtcttttagtttatggtcatccacaacggtatccggagtatacccgcgctccagctgcggagtatataccagcaatggcttaatcgaacttcccggctgacggtaactctggtatgcacggtttaacgtatagttatccgaatcctgcttacggccgcccacgattgccacaacatatccgctgttgttatcaattgatactgctgccgcctgcatcttgtaagttccgtctttggatttgtctttaaatcctttcagggtatcatcaatggcagactgcagttccttttgtttttccatatcaatcgtcgtatagattttgtatcctccggaaaacagtttcttctgacacgcactgtaaagttcgtcatatgcttccccataagacttcttttccttatccgaatcaaaataatatttaaactggaaaccttcctgttccatcagtgcacgggttgcgcagtcatacgtgtaagtgtcaatcgaactgttaattttctccgtgtcactctttttaggccggttcagtgcaatctcttctttggttgcctcataatactcttcctgggagatttttccgtcatcccgcatattctttaagatcagattccgccgggtaatggtattgtccgggtgtgtcaccggatcataattggacgggcggttcgggatcgcacacagatacgcggtctgcgatacatcaagatctttcagttcacagttaaaatatccatgacaggcagcgtcaattccgtaatagccgtttgcaaaatacacgttattcagataaaattccataattttatccttactgtaacgtttttcgagttcccacgcaagaaacatctgcttcaccttgtactgccacgtctgtttcggctgcatataaatcagcttggcaagctgcatggtaatcgtacttccaccctgcgtaccaccctgcgattttttcagtttcgacattactgtggctttgaccgcgcgcacaagtcctttcagatccacaccgttatgctggtaaaacttcttgtcctcaatactgataatcgctgcgacaaaattctttggaatatcctcgtatttgacatactgcgcattcttgtctccccttcgttcagagatcagttttccgtctttatcaaaaacggagcaggtctgtgaagggataaacgtagaatcgtcggaagcagatacttcctgcactgcctcacggcgcatctgctgtatctgatccgcatatccgccaaaatagtagtatccaaaacctgccagcacaacaagcatcagcacgatctgcagctttatgacaaaccagaaaaagcgatgctgctttttctttcttttctttttcttcttggttgacatatactctcctccatatttattttggaaacatacatcatacattttatctcttttggacagtatatgcaaattatctttttattaagattttattattttcactgctccatatttttccccagaaaatttgcagctgtggcagacaatgctttcaacagtccaagtgtttccttttgtccgctgttatctgccagaatcacagcaccctgacagtctccattgcacagaatacttgaaagcacaattcccttcggaagtgttgacattgttttttttgtaatggagcaggcctgttcttctcctgttttcacaactgtgctgcgcttttcaatcatttcttccatctcttcgctcagctgttccccctcaacttcctttttcccggttcccgctgctgcgatcacatattcccggtccgtaatgcagaccagagcctctgtggtctgtgccagtgcctgtgcataacttcgtgcaaactcgcccagttccccaaccggtgagtattttttgagcataatttcgccctcccggcttgtaaaaatctccaggggatccccctcccggatgcgcagtgtcctgcgaatttctttgggaaccacaattcttcccagatcatcgattctgcgcacaattccagtcgctttcatatgataaatttcctcctgttttccagattactttccatattcatgttgtatgggtagtatgccggaattccggaaaaattatgcacagaaagcaaagcattttacttgaaaaaacgttcatcccgtcatacaatagaattagcattcacataggagaaacgtattatggattataatgaaaatgaatttaaggccaaggccaatatcaaaaccagacgcatctggcttgtatttgcccttctgcttagcgcaaactacggctcagatgtatcccagggtgggtatccttccacaaattacatcatttttttaatactgtgctgggttcctttttttgccggtgatcttcttttgcgcatcaggggaaaggccgatgaccgctatcggtatgcacttgtcatcggttacggtattttttacacgttcctgatctgcaccaccgattcaccgattgcctttacctacattcttccggttgtcagtcttctggttctttacaaagaccggaaatttatggtgggatgtgcaatcgccaatattgccagtgtcattgtcagtgtcatttatcatctggtcgttctcggtcagaatactgcaacggaccagaaaaattatcagctgcaggttgcctgtctcctgctctgttatatcggctatatcatgtctatccgccacctcatcgaatccgacggtgccctgacagacagtatcaaagccgatttaaaacgggttgttacaactgttgaacaggttaaaaccgccagcaataccatcatggatggaatcaccgttgtccgcgaactcgccacggaaaacaaacatggttctgacattgtcgtagacggaatgaacaaactgaccgaccataacggccagctgcagtcccggacagcctcctcgcaggaaatgacaggagatattaattcccaggtacagaatgttgcttccatgatcaatgatatggtatccctgactgcggaatccggcaaacatgcaaaaacaagttccgttgatctggagagtctggtacagactgccagaacgatggcagatctgtccaatgaggtagaacatattctggacgctttcaaggcagaatttgaaaccgtaaaacaggaaaccggaaccattgacagtatttccagccagaccaatctgctggcacttaatgcttccattgaagctgcccgcgcaggggaagccggaaaaggattctccgtcgttgcggaacagatccgcaagctgagtaccgaaaccaaagattcttccggacagatcagcgaagcactctcgcggctggatgaaatttcaggaaaaatgacttcttccattgaagaaaccttaaaacttattcaggtcactctggaaaaagtaacccagaccggtgaaaatgtaaataaaattacacaggattcttctcttctgggtgaacacatccagacaattgattctgccatgaaagaagtggaatcttccaatcgtcagctggtagaaaatatggaacaggtatcttccatcgtggaaaccatgaccacatgcatcagtgattccgatgaaacaagcaaacgcatgctcagcaaatatgaggaaagtgcttccaacatcaataacatagaaaatgtaattcaggagctgatgtgtgaactgggcatcggtggtttcatgggtctggatgatattcatgccggtatgaaagcaaaagttattcttccaaaacatctggaacgcatggagtatcacggagaagtcagatctgttgcggaaaatagtatttccctgattttgtctgacaatccacagttaaacggatccgaaacctgtaaggttcaggtcacggttgacaatgttctctactgttgggatcaggcgcagatacaggctgacacggcatccggttcccatgcctatgtattgcagctttccgcacgtccggagatcaaaaaccgccggaaatacccacgggcagatgtgtccaatccatgtaccatcacgctgaaagattccgacacaacgttctccggtcagcttgacaatatcagtgccaatggatttgcatttctgatccgggatccgtttttcatggatcacaaacatgcagatgttgctatcgatatccaaaattttgccctttcggatcagtcccatctggaaggacatgtcatccggtgctcggatgatgaaggtgtatatattgtgggatgtcagatgccggaagacaattatgcaatacgcaattatgtagattcccttctcggtcaataaataaaacagggaaaacttctatgattccataaaagttttccctgttttattatcatttaagctgtcagcaaaagtttttcaaactcttctttgggaagcggtctcgaatagtaatatccctgaatactgtcacacttcatctgtttgaggaaatccacctgttcttctctctcaacaccttctgccgtaacgcacaatccaagttcctttgcaagtaaaatcgtatgttccagcaatcgttccccactgaaatccccgatgtaatcaatcagacttttgtcaatttttaacgtatcgaaacatttcatgttcagtgttgcaagggaagaataccccgatccaaaatcatctacaagtaatggaaaaccattatcatggaacttatctgccagccccttgatattgtcattgtcaattgctgcgctctctgtaatctcaatcggaaccagatgggtttttactccgatttcatcagcgatctgctgataccggctgaccacactgtcaaaatacagactcgccctggacagattgatggataccggaataatctcctttccctgtttctgccattctaactgctgcatacatacttttcggaaaacatactcatccagaacttttatcagtccgtctctctcaaacaacggaatgaatttgccgggtggaataacatttcccttttcatctctccagcggatcagaccttctgcccctaccatccgctctgtttccggatcatatttcggctgataccacacctcaaaacagttattttccagagaatgtttaaattcatcctccatggctttatcttcaagcatgcggatcgtatcttcatggctgtaaaactgatagctgatatctttgcgatccttgatctgattcttggcaaaatttgcttcgctgtatacctcttccactttagcatccggtttccacttcgtcactccaaaataagggatcagcttcggaaccttcagcctttccgacagttctgccagtatggtccccagctgctgtaactgccggatcgtcttctcctgatcctttccactactgtaaatcacaaaacggtctgcattgatatgtcctgccagatcacctttttccagtatctcctgaatacatttccagattcctttgagtgtttcatcccctttgataattccacagatcgaattgataattttaaaggagtggatgtccatggacaccagatatcccggttgccggaaatcccggcttttcttcttaaaactttcgtaattatttccaccggttacactgtccacatatgccatgcgctcaagttccctctgtttttcggaactgatatcggaaaatcctgctaccatccggtgcagctgtcctccatccgatgtatttacaaattttgcacggcagtattttactttcccatcccgcacaatccggtaatcatactgatatgcttttttcaggctcagctgcttacggagattttcaatggaggtctcatacagcattgtctcacggtcttcggtaaggacaaccttccccacatattctgccatgatagcttcatatcccggaattgccttaagcgtatcattgagcacagagcgcactgcggagttcactttatatgcatataccttatcatgatccacatctacataatatacactgttaaaattgcttcccagtgcctgaataatctcattctggcgtgtgtctgccctgatctgttcgatcaggcccaatacatattccggctgtttctgtgaaccgccctgaatcccacccatagagatctgatataccacgtcttttcccgaagactgaatctttgcacttaccgtctttgcgccatggtcaatatcctgaaacagttttaacagtttttctttttccataattctgtccatgaggatactatgctccagatccgcagcattctcaacgattcccatgtgacgggctgcaaactctgatggtctgatcctgtgttctttgggataatagtaaaaaaaatactttccccattttgccagaatctcctgaatctctgttgatatatccctgcacttcttctgatcgattttttctaccataggcctgcctttccctggtaaactgtaaatattgtctgattatttctgtacaaatatactatagcataaactattttcctcgtaaaggtagtaaattttcacaaaaacacacgaaaagcgcatgcaacagagatgtcacatgcgctttccaactacacagcattcgcttatgttctattttattttacggtttctaccttaatcacattcgtatttcctactttgccattgatcagaccaccggtcagaacaacagcatctccggtctgtaatgaaaatacttcttttgcctttttcattgcatggtagaacataacttccatcgaactgaattcctcgcagagaaccggagttacgccccagcttaagttcagtttccgccataccttctcggaagtcgtcattccgatgatatctaccggacaacggaaacggctgaccatacgtgcggtagttccgctgagtgtacttgcgacaatacattttgcctggacatcaactgccatcgcacaggttgcatgcgaaatagcatcctgaatgcttctggtctcaaaatcagaagtgcggaaacgcttggtatatttgatctgggattctgtatactcagcaatctctgccatgttccgcacggcatctaccggatatttaccggcagctgattccccggacagcatgatcgcggatgatccatcgtataccgcatttgccacatcggaaagctctgcacgtgtcggacgcggattgtgaatcatggactcgagcatctcggtcgcggttatgacacgttttccgagcatacggcacttactgatcagatacttctgaaccgcaggcacttccatgcccgggatttcgactccgagatctccacgggcaatcatgacaccattggcaatctcacagatttcttcaatgtgctccacacccgaacggttctcaatctttgcaataatatcaatatcttcgccgccgttctcgtcaaggaatttacgcatatcctcgacatctttctttacggaaacaaaagatgccgcaacgaaatccacgtcgtttttgataccaaacagcagatctttcttatcctgctcgctcaaaaatgcatgatccatgaccttgttcgggaaattcatgctctttttatccgacacctcgcctccgacaagaaccttacagatggcatccggtgctttcagcttttctacttccagaataatcagaccattgttgatcaggacatgatctcccaccttcagattgttgatcaggtttttgtaggttacggaaactctctcctgatttcccacaatatcatccgttgtcagtgtaaatgtatctccatcttttaacgtgatctttccgttttcgaaggttttgatccggtactccggtcctttggtatccagcatgatcgcaattggaagacctaacgccttacgcacttttttgatcgtatcaatcttcttctgatgttcctcatggcttccatgggaaaagtttaatctggctacattcatgccggctttacacatctgtgtcagtacagattcgctttcgcttgcaggtccgatggtacaaataatctttgtttttctcataatgcttgttctcctgtctctatccaaatttttttgtatcccctgagtttcattctgtcacacacagacgggatttgcgcggatataccgcccgacgatcagccgacgcgccggtggaacaagaaatttgggcttcgaggtcagaattctctgtaccagcagccactgctgtgtcatatggctcaccggaaggaaacgaagcccgattcgcctgacttgcggaacaacggacggtttcccttccctgagcactgtctgggaaatgcaaaactctcctgcatcattcaggtaatcctccgcctgccggttatgcatactgctgctaagcacattgaccttctgctgcattccacaggcatctgctacattcatctccaccggcatgcgaagcacaaacgccgcaatgaccacagcggaacagatcagcacaatatgatgtttctttttggtccgttttccgaagtgcttatgcatttgcaatcacatctgccagagcttccatcgctggtaggtcggactctttcatggcggaacggatcgttaccatcggctccacaatggtaatatttttcatggtttccagaattcccttcatcgttcttccggccgtcggtccccaggtaccgttctcaataatacctacggtacggttctggaatgccttggactgtaaatgatgcaggaagtcctgcatacatgggaatacaccgccatcgtaacttgctgctgcaagaaccatacggtcataacggaacgcatcttccacaacttctgccatatcatcacgggaaagatccatgacagaaactttctctactcctttggcacgcagcatctcagcaaatttccgtgctgcttttgcagtatttccatggatcgatgcatatgctacaagaacacccttatcctccggcttatagctgctccaggtatcatataatccaatgtaataaccaagattttcatttaataccggaccatgcagcggacagattgtctggatatccagtcctgctgctttctttaacagtgcctgtaccggtgcaccgtattttcctacaatattaaagtaatatcttctcgcttcacaggcccatccttccggatcttcataatccagtgcaccgaattttccgaatccgtctgcagagaataaaatcttttcactgctctcataagttaccatcacttccggccagtgtaccatcggtgccatataaaaattcagcgtatgggtaccaagggacaaagactctccttctgccactgtaattttatggttctcatctaccggaagctcgtcaaaaaactgtggaagcatctgaaatgtcttggcatttcccaccagagttacttccgggaaaagctctaccagacgtccgatacttccggcatgatccggctccagatgggaaacaaccagataatccactttccgtccgtctaatgcggccagcagatttttctcccactgctccacacctctggtgtctaccgtatccatcaaagctaccttttcatccaaaatcagataagaattataagatacaccatgtggaaccacatactggctctcgaacaggtcaatcgtcttatcatctactccgatatactttactgcttctgaaattgttacactcattttttctccctctctttttgtttttatttatgtattatgatgcatacatatcattttcttcttcacgcgctaaatcctccggactcatatagcggcggaacaggcgctctaaaataaaatcaaatacaatcgatgcaactgccggaatcaccacaagcagtaccggtataatataaatcgacagagccgatgcaatcaaaatcaccagcagcagcaatgcccatggcagatgccttatcatcagcagaaatgcatttttcaatgtctgctttacggtattttcaaatcttgcaatatatgggaataaaaatgcgctccacataatcgcaacagcaatcataatcagaaagaaatagaaaaatgcgcccttcatactgccggtttttaatacctgataggtgatataggcatcacagcccagaacaatcataacggccagccatataagatatggcagtgttgcagccttaaagttgtccctgaacgctccgaaaaaggttcttgtggtatatccgcggtcaccgcggatggatttatgtaccgtgtaatacaacgcggtggtcgatgccccgatcgtaaaaaccggaatgcagcagatcacccataaaatgctgacccacacgcagtccacaagttttcccagcatctgaaatacaatattatcccaattaaatttcacgcttattcctccagtcgcccaataatttcttctgcgatttcttcttttgtttttccatccgtagctacgagaatgtctgcagccgcctcatactttggccggcgtacttccatcagttcagaaatgtatgcaacattcatatgaccgtttaaaagtggacggtccgtactgttttttacacgttcgtatatggtctgcggtgttgccgtaagaaatacaacgcttcccccatcccgcatgcagtctacattttcctgtcgcattgccacaccgcctccacaggatacgattgtcggctcctgctgatttagtgactggatcagttttgtctcaagctcccggaaataaagttctccgtatgtttcaaaaattttgctgatcggcattccctgttcttttacgatacgctcgtccatctccacaaccggataacccagcttttgctttatcgcacgtgcaatcgtgcttttaccagctcccataaaaccgatcaggaaaatatttttcttttctttattcatgaaaaatttctccttcacttcttctaccggcatatccatacctgtatataaccggaatgcggccactccctgccacagaagcattcccttgcctccaatgcaggtacatcctgcttcttttgcttcccgcaacagttttgtctctgccggattataaaccgcatcacatacaaccaatcccgggcgaaatgcagataaatcttttaccacactctggtcatccatcggtttcataccaacgatcgtcgcatttgcaaaaatgtcactggatgtgatctcctctgtcatctttgccgtatccgcaatgtcatatacattgacaacaattcccggcactgcttttcggatcttttctgcggtctgaagagtacgctcaaaaaatgcatccttaatattgaaaatcgtgatctctctggctccatctaatgcacattgtacctgaatggctgtcgcagctccgccaccgcctgcgaccgtgatcttttttcctttaatatctacgccatggtctttgaggttgtgtacaaagccttctccgtccgtgatatatccggtcaatctgccgtcatcgtttacaatcgtgtttacagctccgataatctgtgctgccggagacagctcatccacatactttgccgcctcggtcttatccggcatcgtcacattgattccacgcatatgaaacagtttcaccgcgtcaagtgcttcttttacctgatcttcttttacatcaaatgcaacatatgcataatccagccccagctttgcaaagctgtaattgtacattgccggggaaccggaatgtcctaccggcgaaccgatcagtgcaagtaaccctgtatgtcctgaaattctttcttccatcttttttctcctgtccttgtatgttggttatatgataccataacttttaaattaagtacaacaattccagtggcctttgaataagtacctgtgctctgtttttacgaaggaactccgcatcgcggaatccccacatgaccgaaacacatggaagtcccgtgttttccgcggtctgaatatccacctcggaatctcctacataaatggccttcttcgtgtccgtttttaaaattttcatggctttttgtaccatatcaggtgccggtttttttgccacaccttccatctcaccgattgccgtagtcatataaccccggaaaaaacgttcatccaattcttttactgccgagtccagcttattggatacaattgctgtcttcactccgcgcgcctttaattcagtcaaaagatgcatgatatccggatatggctttgtatgatccagacaatgctccccgtaatattttttaaattccgcaaatgtctcttcaaacttcgggtttttctccccatccggcacagcacgcaccatcagcatgcgcaccccgtttcctacatatctgcgcacctgatccagcgtacaagtcggcatattctgtgactccaatgccgcgttggtagcgttttttaaatcttccaacgaatataacaaggttccgtccagatcaaagatcacacttttttgctcttcctgctcaccggaatcccgatagatttcttcaaacagatctttacgcataatccggatattgttgatcgtatcactgctgtcaaccatgtaatctccaacccggccaagtgtatactgttcgttttcctctttatcccggaacagttttaccttgcgctccagcctgcgtgcacgaacaattgtagttccctttggcacgcagacctttgcacatttcatcggttctacgatgattcctttctctacatctttgatggtaggttcatactctgcatttctcagatcaaacttccaatccgtgtaaatccggaattcttccataaaagcctcttcattacgaaagaaacattcccctttcggtccaatgataaaaacaattcctgcttccactgtagctttcatatctccctgcagagtccgcacagtcacctgcgttccctccgcaaagagatccgttgcccggacatatccccacggaacggagcgtctgcagtacgtctttgcatcctctgcctctattctgcaatcctgtgcatacacaatatcggtatttcccatatagtcccgcatacgctgctcgataacagatttaatacccgaagctgccggctgttcatgtcttccctgtgcatcatactccatgcgcggtgcaaaatgatgttctttgcaaaactttaaatattcctgtgtcatcaattccatcggaatcagaccacccgctttttccagatgtcctccgccggaaccaattcctttgcacaactctgccgcaagttcactcgccttgacttctttcacacagcttctcactgaaaacttcacaccttctggttgcagattaaatgccacacagatatcaatcgcatccacttccagtaccagatcggaaatcagtccgagaatattcggatcacactgccccacttttacaatcgcggcacgaaattcttctacataatccgtatgaagaagtgctgctccagcgacttccagttcttccagcgaaagattggcattgcggagtttcctcatgattgccgggtcaaagtttgcctcgtcacgcagatcccggtctagcggatgtacaatttccgtcaaacttccggtatccgtatataatccataatacagtgctgttgacaactcacgattaccccgtacatcaaatccttctgttttgagcatattccagaccagtgtcgagcacgcgcccagattagaacgcacctcggaaagctctggtaattccgtgcagatccggtgatggtcaattacagcaatatgttctgcttcaaacactgcagaatttccggaatggtactggcagtccaccatcaccaataactctggtttgtgcagataatccacatgctcgattggtattttcagatcccggatcagcatcaccagattcgttttccggatcacattctgccctccgtaaatcagacgtggttcttttcctttggatttcaaatacagatagaccccaaatccacatgcaatggtatctgcatccggattgttatggcactgtattacaatattatcatacgctaataactcactcagtttcatcttaattccccttgcctgattgttctacttgctttttagattatatgggaagaaaaagctgctgcggttctttttgtcaaacatcgaattatattgcagcatatgatacttttcaatccattctttttcttctccctcggcctcatcgatatgcaaatagcaacctttacttttggaataatagcctctggaattgatggctggaacaacctcctgcatatctgccagaaacttattgtatgccggaagctcaattccagcccgttccagtgccatggtagacagataatcaagactggtaatgtctaccgtttcttccggtgtatcataattggtccagataaaaaacggaactgtgtacagtttttccagctcatcttccgtcagccctgtgagtccttttccattcagaatcggataaaaattactgtttaagcttggctgatgatctccaaagaaaatgatttctaccggatcatctacctttgaaaaataactgatcaggttttttactgcctcatcactctcgtgtaccagggacagatactggttggcatccgtataagaacgtccaactttataataattctccggaaaattgtcataggtttccgtataaccaccgtggttctgcatggtaattcccataaagaacagtttttcattatttttacggttttcataacgcttgataatcttatcatacagttcctggtcggtaatatattcccgcaggatctttgtctggtcaaaataatcaataaagtgcatttcgtcaaacccgatatgcggatacaccagattccggctccatccggtttcataatatggatgcatggcaatgcacgtatacccgtcatctttcagatttgacacaatcgttgtcggagtatcactgatatactgctgataaacaacggatcccatcggaagaaatgccatggaatttccggacataaattcccactccgaattaggagtcttcgcgccaaataccgacgaaagtgcatatcccttcgttgtattctctttcaaagaatcgataaacggtgtgagcggcatgttggtctgcagatcccccaacacactcagatcggaaaacgattcattcataatggcaatgatcgtcggattttttgctttttcatttgttgtgctgtaatcctttttatcggattgataggttttctccagttctttgatcttatctttggaatatccttccggagcagaaataaaactgtcacgaatccccagtacgtaattcaacagatatccattgcgataagttcccttctgttcccacgtctctgtgtttacatcataagcatttgctgcaatgatcacacaacttaaggcaatcgccatcacagaaattacccgcatctgaatttttccggtaaaccggacatgccatttgcggacaaaagcaataaacaatgctgccagaaagatcacatatactccacgatcgttcaattgcaatttataatttcctgccacactcagaccggttccaatggatctgatatcggaaaacgtaaattcatttccgcggaacagatatacaaaatagtctacaaatccaaacgaaagcagcgacacatgggcaatgatgcaggtcagcccactgttgttcgtaaaaatctgcacaacaaaatagacaatcagacagcaaagcacatttaaaaagagcttctcgtacgttgtcctcgtaaagttttcaggatcaagcagcatatactgtatcgaaaaagtggtgagacaggaacctccgataaacagaatcagtgtccagagccacggacaccggtcatccagttccagatgcagactttttaccagatagtacaaaaatccatatgcgatcaatgcaacgatggaaaaatcaatggtcacatacattacgactgccaatataattgcaatcgccgcccatatgttattttttttatcgtattgaagtttgattttaaattttggtttcatgccattacaatacaacaaaattcccggcatgtaaaccgggaatcctgtctgaaatcttaattttgtgtgaattatttctttttgaagtttgtgtatcccttctgcttatatggatgtgcagcccagagtttatctgctgtttctttccaatcctttgcgtaatctacgcactttccacacagatgctcaaccggctcctcctgttctacatctgtagaatgagctccggtctcatgaaccatcttctgtaaaatctccggattctcaagcatcggacatggacgaagcatgttttcgttgaatggctggttatcacggtaagccataaacaacggctgcttcagacactcaagcagggatttctcgcggatgtttgctccagagtagtgaataaatacacatggctctacatcacccttcgggttaatatgacagtagttacgtcctccggcgatacatcctccaacgtattcaccgtcgttctggaaatccataacgaagatttcttttccaccttcaaatccacgaacttcacgcagtctgtggtaaatatattctctctgctccttggtcggcatcagttccggtgaagccttcattcctaccggcatcagatgaaaataccatgcgaaacggcttccatgctcgatcagaagatcaaagaactcatcactggtaaccgcatccatattcttgcttgtataacatacactgtttccaaagatcagtccgttctcatgtaacagatccattgcgtgaaggactttattgtatacaccttctccacgtcggaaatcgttggcatcttcaaatccctcaagggaaatggaaagggaaagatttcctacacgcttcatatcctcgcaaagcttctcatctacaagtgttccgtttgtgtagcaatggaatgcgcagtcattgtgtttctcacacagacggatgatatcagccttacgtaccagtggttctccaccggtcatcatataaaaatatacgcccagttccttaccctgtgtaacaatgttgtctaactcatcaaatgtcagatttaatttatgaccatactctgctgcccagcatcctgtacaatggaggttgcatgcactggtcgggtccataagaatgagccacggaatattgcagttctcaatttctctcattttacgaatcttcttggttcctgcaaacgctgcctgatatccaagattcagtgctgtcatcttggcaacatgcggatctgtctcatccagaagacgattcacataacgcatccacttgctgtccggattctgaatcattttctttgcgccttcgtatgcctcagaacggaaattgcttcccataaacttctgtgcgaggtttacaatattgagcaaacctttctctctgtccttattcagactctttaacgtagcatcgatagcgagcgaaaacgcctgtctttctgccgcatcttttaaacttgccattttcttactcctccgttttctttcttgtgtaaataaatcataagatatttcatccattggaagtatagttgtttttccaccgaatgaacatattcaatcacaaaaccatgtatgtttgcaatatacaatcttctgaaaatgtctaaaaaaacatgatttgtgcatttttccaacgatttttggatataatttttgttgcagactcaaaacgtagttttgaatactacgtgacattataccactatcttatgtaaagtcaacataaaatatttacatctgctgaaaattgaccgaagcaataaaatatactataatgctgttgtttctttaaaaaattgattatttactgaagattggagtgattgtatgccgggttttaccacccactatctgtttggcatagacgcatgcagacgtctgacctccacatccatgcacaatatgatccgacgcgatcacagcgcatttgcacttggtctgcagggacctgatctgtttttttactatcttccctcttacctgatgcatcgaaaaaatattggagatctggcacatcgcaaagatactggccagttctttgccaatctgctgcaaagccgcaaactttttgcagggaaaaaacattccctctctattgcagacgcttacatctgtggatttatgggccattacacactggattgtacgattcatccctatgtatatgcatttacaggctataatgcccagaccccaccttccaatacggaatattttggtcagcatgcttatttcgaaacggaactcgattccgaacttttatatgagaaaaagcatctgtatccttcccagtttcatcagaacgcaacgattcgtctgacgacgctccagcggaaagtcattgtgcgaatgctgtgttacgcataccggaacacctatccggatatttccgtgagtgaacttttcctgagcggtgcaccattctggatgaaacttggaacccatttactgaatgatccaagcggacaaaagaaagtcttatcccgtctgatcgaaaagattttccttggacgtgcttttttatcaccgatggttgccagcgattattatcgttttataaaagatccgatgaatctgcaccaccgcgtctggattcatccatggacaaagaaatcttccacggcttcttttccagagctttatgatcaggctgaaaaaatttatcatcaacgtctggtccaatacgcgcatctgcagcactctggtttcccgcaaaaagaaaccgcacgctttctgtccgcgtacggtaatctttcgtttctgagtggtctgccttgtgatgaataaaagagtttcttcctattatataagagacatatgattataatataatctgattttggaaatccgcaatctgctgacagataatttccatcaaacgcgtgcgtgcttccacgcttgcccagccaatatgaggagtgataatcagcttttcgctgtctttgattttgcgaagcggattatccttccgcattggttctgcggaaaggacatccagccccgcacccgcgatttctccggcctcaagcgcatccgccagatcctgttccacaacaatcggtcctcgtccaagattcaaaaaaactgcagacgatttcatttcccgaaatgcttcccggttcatgagtccccgcgtatttttatcaagaggtgcatgaacagaaacaatatctgattgttccaacaacgcatcaaattccacacgttcatatccctgctgagaattcttaccggaagtggaataatagatcacccggcatccgaatgcctttgcaatatccgccacacgtctcccgatatttcccagaccaatgattccccaggtttttccgctcagctcatgaaaccttttctcaaaatgggtaaacataacatctcccacatatttctccgatttgacatactgatcataatacgcaagcttttcccaaagataaaacagcatggcaaacgtatgctgggctacgctttccgtggagtatcctgcgacattacgccattctatgccacggctttttaaatattccttatccagattgtttgttcccgttgccgtcacacagacaagtttcagtttttttgcttttccaatcgaatgctcattaatctccactttgtttaacacgatcacgtctgcatccacggtccgttccaaagcttcttctgtagtggaaaaattatatgttaccacctctcccagtttttcaaatgcagacagatcaatatcatctccaattgtttttgcatccaaaaatacgattttcattttatcctcctaccctattctgattccaaaagaaaaagaggctgccttttctaacatcctcttcccctttacatcctgtatttatatctatgcaatcgaaaatgcatagaccgtttttgtatcatatgattttccggcttctgtcaatggtgttgtaaaatttggctcattgatggaatttggaaaatactgtgtttccagacaaaaagcatcccgctctttgcatactgctccgccctgcactttctgtccctgaatgaaattcgccgtgtaaagctgcataccgatacaatccgtaatcacgtccatctttatgccactctttgtactgtatgcggtggcaatcttttcaagccctgcccgctccttatccagaacaaaattatgatcgtatccatggccgtaagaaagctgatcatttgcctgctcaatatctctgcccatcggctttgcttcccggaaatcaaacggtgttccatccaccgaagcaatctcaccggtcggaatggattttgcatcaattaccggtgtgtaatgagacgcgcggatctgcagaatctgttccatggcactgccgcttccggcaccattcagattgaaatatgcatgatttgtcatgttaaaaatcgttgtcttatccgctgttgcatgatatgtaatggaaagttcgttcgcttcagttacttcatacgttactttcataactgcattccccggatatccctgctgaccttctgcatccttaattacaaatgtaattttgtctgccgtctgttcctcagcatcccacagacgtcttgaagtcgcctgtgaaccactgtgcagattattttcattatcgtttttctcaagctgataggtaactccatcgatcacaatttccgcatttgcaatacgattgcagtttcttccaacaactgctccaaaactggccatctgctgctgataagtctctgcattttcataaccaaggaccacatctgtattttttccgtccttatcttttaccacaagtgatacaatggatgctccaaaatctgtaatctgtgcatacatccccttcgtattggaaatagtataaagcgttgcctcttctccatctgcaagctttccaaatgtttttcgttccataactgtaattgcctcctgaattcatctactctgttcctgtctatataaaatattttaccttgtttgggttaagaagtaaagaacaagtgccgatgtaaatagtaaaaatatagaaattataacctttttaagaaaggatgtttattatgtccacaaaagtttcctctggggtatcattatccacgaattattttttaagaaatttctataccaacaatcagaaagcagccaaaacctccggccggtccggttacagtaatgtggagctttcctacgaagacagccgtgctttaaacagggctgccaagcggctttccaaaagtgattttggttccgacacggatgagaaagacgatgatctcaatgatacatcgaaggctgccattgaagcctttgtggatacttacaactatacggtcacttccgggaaatccagttccgactacgaaaccaaacgttatgtcaagcagcttaacacgctgagtaaaaaacacgcagacgaactggaagatttaggtatcacgataaacagtgatggcactttggatctcaacaaagaccttctgaaaaccgccaataattccaaggcacgaaagttgctctctccggatcaggaatatccgcagaagctcgtcaagctttcccgtaagatgaattccgctgtacaggagaacattatgtccttgatcagcacgcagaatatgcatattgacatctccttataaaacgcaaaacaaaagtaggtgatacggttcgtatcacctgctttttttatttcactgttcttataggaactcatcttcttttggccagagatctccctcatttaatccgtgctcagtcagccagctgtcctccacagaaaaacaggtttcttcttctttttcattgatcagagtcaccgacaccttcggccgctgcccttctgccagttcctcacacccatactctccgtcaaaaatgtgcttgatcttccacatatgacactccttttttccagacattaaaagatttttctaaaatcgaacgctttctattgtaccacatgttccttcacaatcacagttgtcagatatccttttgcctgttccagttcatccaggccacaatacacctgttcattctccatgccgcaattggatattccataaatgtcctggtgcactctgctctctttatcctgcatcgcttcccggagcacccgtaataactcttcgagttttttcccggatttcatataaatgcgtgtaccataaaaaccgagtgactcacgcacgtcatacgccgccggaataatatggatttcctcatctttttctcccagagaaatccccagtcttgccgctactgcacaaaacgacggcacaccacttacgatccgcgcctcccagccggcatctgccgcacatctgtgcatatacatataggtagaatatatccccggatctccaattgtgagcattcctacccgcagtccctgccggagataatcttccacagcatcataaatccgtttgtgtgccagttccagtttctgtgcatctttgatcatcggaaatggcatgcaaagaagtggcatatctgcaatttccggacaaacctgctccacgatccgatacgcataacattcctcttttgacactgccggaagcacaatgagatcacagctgcgaatcgtttccaatgcctgtatggtcataagtttcggatctcccggtcccacaccgattccataaaggatacccggacgattttctgttgttaaatcacaaaataattttttcgttacctgtcgcaaatgagtcagatacacctcccggacagccggatactccccaattccccgaatcacacattccggctggtatccggccgcctgcaattctccggcaaaggaatccgcatccggctgctccccgtcctgcatgccgcctgccatatcattatttgcatggtctcccgccaccagcataaacggtgtaagaagcactttcccgttctgtctgctctgcagcccggacttcatccgtgcaatcacgtcttcaatggtaatacttccctccactgttgcgatatagatttcatgctttgcataagcacgcagcgactgttccatcatcgcataactggcatctgccgcatgttcggttccatgccccatcaaaatcaatgggaaatctcccacctcttccttcagcgactcccacagtgcttttgccacatcctcataatcctgcggttttgccaaaagcgcatcggcaactgcaatctgctcgaaagcaccggcatattttttcgccgcttccttgagtctgtgattttcaattccgtcaatcacatgggtaggaaatacagctacatgcgtcactccctgttttttcatgctttcgagagcttccgccggactctttacttctatatgctcgcgctttttcattgcgttacgcacaatcgtactcgagacagcttcctctaccacggcatccggatacaatgcccggacctgccgcgtgatggctgcaatatttttctgccgggtatccggataggttgttccaaaactcacaattaaaattgcttttttcatgttattttgcattcctctctctgtgatataagcgtgctgcctgtacaaagtgttccacaaatgccggattggacggataatacaaatgtggataaccccaccagtttctgtcgtcctcgtggatacatgtccaggatgttccgcttaccggtttgaccgccacgcagctttctccattgttatcactgtcatagtaatgaaattcatgtgcacggacaggttttcccgccaggaaatgggacgtctgttccatcacatttacatagccaaaacgtacaagttttcccctgttatgacagctgcccgttatgacccctgccatcggccagttttctccttcttcatctgtcatggattcatgcagatacataaacccgccgcactctgccacggacggcataccattttcaattgcctcccggatggaattgcgcatggagacattttctgaaagctgccgggcacacagctccggatagcctcctcccagaagaagcgcatccgcttcctctggaattttttcctgtccaagcggcgaaaaccagacgagttttccaccatacgcttccagaagccgcaggttatcctcataataaaaacaaaatgcctcatcttttgcaactgcaataaccggacattcctcctgctgtttttcctttttctgtaaaacccctttgtcttttcccggttccggtaatttagacagtttcgtttttccgtcccgaaacgcatgtaaaagtgcccagctttgcaacagctgcagcatccgatccagatctgcggtctcttccagtttttccgcagcctgattgacctgcttgcgcagaccttccatttcctgtggcattttcaaacccagatgccggctctccagatgcagatttttctgtaccggaaaacatcccagcaccggaaggcccagttctttctcaatcaccggcgtcattgtccggcagaacccttccgatgtgcggtttaatatcacaccaatgatccggtgatccctgtcatactgtaatatccctgccagaagtgccaccatcgtgcgccccatcccacgggcatccagcacaagcacaaccggcagatccagagtctgcgccagatgataggcggagccctctttttgtgtgcctcctaggccatcgtataatcccatggctccttcgatcaccgaataagagaagctctcccggtcatatccatacagttcccggatctgatctgcccctgaaaaaaacgtatccagattgcgcgacggtacaccaatcacctgacggtgaaacatgggatcaatatagtctggtccgcttttgaacgcacgaactgcaagttttctgtttttcattgctgccagcaacgcacaggtgattgtcgtttttccactgccactttgcggcgctgccagtaccattccactgtgtaacatagttctctcctcattatgccatcgtcagcacacagatatatacggggttctcagcctgcatcagatgataggttcccacggtttttgctctgctgacctgcacctgtatgatttctgtctgcattttccctgcagcaagttctgtaatctgagccacggtttcaagacttatggcattgacaaccacacgtgtccgtggattcttctcccagatgacatgcagaatatccgcaaggcgtccactgcttcccccaataaatacatgtgtcggaggttccagggattccaatatttccggtgctttcccatccaccggaatcacatttgccagatgaaatttttccagattccggcgcagaagctgctgtgctgtggctttttgctcaatggcgtacacacgaatccccggactgcattttgcgcactccactgcaattgatccggtaccgctccccacatcatataccacagcatcttccgtcaggccaagtttacataaggaaagcgcgcgcacttcttccttggtcatcggaaccgttttttccccttccacgacacgcaaaaatgattcatcggacatccctggaacaagacgtcttttttgcacattttcattgcataataacagggtatacagaccttcttcttttacattttttgcctcttcatacgatagctcgcggattttttctctgtcataagagagctgaaatccagcaatcatgcgggtttgcgtcaatttttcttcttctatccagcatccgatccgtcggacatcctccaccccggaaaccagcagaaacgtcttgggaaaatgccggattgcatcgagaacgagtgctctggtctctgcggtatcttttttcccgtggatacttataatttttgcatcctgccaggcaattcctgttgccgcagagaggtaggaaacggatgaaattcctggaaaaatacgaatttttttgtaattatttttatttaattctgtttttattttttctgttccactgtaaaatccagtatctccagaaaataatatggagactttcagtttctggccatccatttgggattccttttgtcttaaaaccggtaaaatatcttttgcgagataaaaaggataggtttccttactgttttccaccacttcgagcatccgttctgccccaaaaaccacatcagactcttccagcgctctttttgcttcctgtgtcagtgtcgctgcactcataccgatgccaatcagggaaatttccacctccggacgaccggaaatcgtatgtccaagcagacaggaaagtgtttcggttacctgtgcataagacattccctgttcctgttcctgtttcccgatcacgcatgccgtaatacctgctttctgcgctgccgcaagtttttcctgaaatccgctgtgcgcaccgctggcttttgtaaccagatagcggatcgaaaactgatggatcattgccagattcatttcctccgaaaacgggccctgcatcgcaagaatctgctttccgcggatacccgccttttcacagagaccgatactctccaatccgggaagcacacgcacaaacaaacgctccttcaggggtgcaaataccgccagctctttgcttccggttgtcagaagaatgtttccggatgtgtccgtaagtgcctggacacagctttcataatcggcaaacacatgcacggttccagcgcgctctttcatgccttcgttttccggtatgctacaaattccatcgtccattcgccgctggagccgcagatatggaattccacttccttttgtactctcccggatgttggcagacacttctgtggcaaacggatgcgtagcatccacgactgccgcatagttgttctgtccgttttttttcagcagggcgcgcatttcctctacgtccagtcttcctacacagaccttcaccccggcaagttccggcatgaccatctgaccgtattcggttgctacatgcacatcacaggcaatatgtgcccgtgaaagttcctgtgcgagaagacgaccttccgttgttcccgcataaattaacactttctctgccatcttattcctcttctccgttttctgctgctatatatggtatcctctcggtgtcacaagctttccatcaataatttttgtctgggaattcccgataaataccgtggtaaacatgttcaccggtgtatgcaccagttcctccatgggaagtgttacggctttcgtatcatcgcgtccgatattttccacatacccacaggcacgctccggttccaccccgtgttccatcagaattctgcaggcacgctccagatagtctgcccgtttatggctcgacggattataaattgccattgcaaaatctccctctgccgctgcaatcagccgctttttaatcctctcccacggggtgagaagatcactcaggctgatcacgcaaaaatcatggttgagaggagccccaagcactgccgcaccgctgcttgctgctgttattccgggaattacttcaatgatacaatcatcatataattttccgatttctagcatcagggatgccatcccgtaaattccggcatctccgctgcagatcaatgccacttttttgccttctcttgccttctcgaaacacatctggcagcgttcccgctcctgccgcatcggtgtagacaataattctttgcacccgaaccgttccccaagcaatttcagatatacggtataaccgatgatcacatcactggcttctaacacctgcatggcttcctgcgtcatcatattttcctgtcccggtcccataccgaccacataaatccggtgtttcatttctttctccttcctttcatttcacgcaaacgcctgtttcacacaaactgcaatacgattttctcccgttttgccacggcaattgtcacgccatccatagcctgcttatgtatcagcaaactacctccgtctgctgcagcgaccgcagcacgctcacatacgttatccactcccacggttcgggatacaaacgcagatgcggtgaaatcacctgacacttttttcagttctccggcagaaaaaacgacaaacggtacccgcaaatgctgtgccagctcccacagaccgggttctttttccttcacatcaaccgatgccagggcatagatatcatccaggtctatttttctgctatccaccaatgtttttatcatttgttttatctcgttataacttttttttttttgcatcccatgccaagcaccgttgttttcggagctaaaataagcgttttactgtattcccgtggctctttttttgtaatccacacatccacagcatgttccgcctgtgcttcgttccacgaaatcagctttacttcctttggcggctgtaattctgccatctcctctggggacatgcatgccggatctaccgccatcacaatgatttcgccctgtaacagttttccagacacatgccggatcgcttcagggttacacacccgcaggccattttttcttgcaaacacatcaacggcaaaaagcccattcacgtccgttgcagtcgtcacaaccgctgtggaatgtaatgcttctgcaatctgctgcgccagttcattggcaccgcccagatgtccggacagcaccggaatcacaaactgtccggcctcatccagcaccagtaccggactgtccacggttttgtggcggatcaaaggtgccacggttcggacggcaatcccgagcgctccaatgaaaatcacgggaaactgctgtgcaaaagcctcttccagaaaatccggaagtgaccggtttcctctttctcttatctgtatctttgaaactgcagggtgaccaccgtaacggctctgccaaaatccatacgaaacagaaagtgaaagttccgcgattcgtgccgcaagctctcttccacgttccgaaaaccaggtcatatacaggatcattccggtaactccttccccacacccgtgtcacgcattgatctatcgtcttctgcgttttttggtgtttttgccttgcggaattcagttgtaaaatccggcgcgtagagtctggagcgcgtataatgctgatttgatattacatctccgaccagcaccagagcggttttggtaatattatgtttctttgccaccgccgccagctcccgcacggtgcagatatatgcttcctcgtccggccaggttgccttgtacaccagcgctgcaggtgtatccggctcatatccaccatttacaaggcgccgtgataattcctccagcattccggtactcagataaattgccatggaagcatggtgtgcggcaaaactctcaatactctccttttccggtaccgccgtccttccggccatccgggtgatgatcagtgactgtgacacatccggaagggtatattccagattcagcgatgccgctgctccaaaacaggcactcacacccggacaactctcatacgcaatccccttctgatcgagaatatccatctgttcccgcaccgctccgtatatactgggttctcccgtatgaagtcgaatcgtgattaaattatttttttctgcctgttccatcaccgaaataacctcttcaagtgtcattttggcgctgttatgaatctcacagccctcttttgcataatcgagaagctgtggattgaccagcgaaccggcatagatgatgacatctgctttctgcagcagacgcattccccgcacagtaatcagatccggtgctccgcttcctgctccgacaaaataaatcatagcaacctcctgagtaattcttctgcttttgcagtcatcccaagcagcccgtaggtattggaatagacaatacacgcaatctgtaaccgaccggccgcacgttttttcagatagaaatcaatttttttcatgatatcttccataacatcttcttttttaccttcggcatcaataaacgcaagtgcttcctcggttgtaacgcaatctaaaatcttctttaaacattctaaagatacattttcacggatgccggctgccgctaaaagttccatccgacaatctccctcatgggaatgggtgttcataatgcctcccgccaccttaatcagttttccaatatgtccggtcagaagcatggcggaaaatcccagttccgccgccatatcgatcgtctcaccgataaaattactgcatttcacactgcggtcaagatcatatccataggtctgctgcatgaaatccagtccataatttcccggtgaaactgccgcaatggtctgcccttctgcacgctgctggcggagttccacacggatggtctccttaagtgcctgactgctcatgggttccacaattcctgtcgttcccagtattgagattcccccgacaatccccagtcttggattaaacgtacgctctgcaagtgcttccccatccggcacagaaatcagaatatgcagtgttccgtgaaaatcacaaatccggcacacttcctgcacttcccgggtgatcatttcccgcggcacatgattgattgcggcattgcctacgggctgatccagtccgggtctcgtcacacggcccacaccctttcctccatcaatctgcagaagttctttttctccatccccacggttgtccgcggtgaccgtggcacagattttacttccgctggtcacatccggatcatcgccgccatccttgaccacagcgcaggaaacctgagattccccgcgcacgatatccgtcacttccgcggtgtatggaattccttttggggtctcaatcgttatacagttttttatttttcccgtcagaagcatatatgccgcagcctttgcagcagcggcagcacagctgccggttgtaaatccgtacctcacaccagatacgcctccttctttcctttataccggccggatctgatataacagtgcgtttacgattgctgccgctacattgctgccgccttttctaccgcggttgacaatatgtggcacatctgtttttaaaatcagttcttttgccgcctctacatttacaaatcccaccggaactccaataataaatgcaggacgccaatcacttttctgcatcagttcatagagtgaaatcaatgccgtcggcgcatttcccacggcaaaaattacaggtttgtcaatatttgctgcatgttccatgctgaccgtcgcacgtgtcacctgccgcgtctttgcctcccgcgccacatcctcatctgccataaaacaatgcaccgttcctccaaattcctctaaccgttttttgttgatgcctgcaagagccatattggtatccgtgacaatgtcagcgccacctgcaatcagttctttggcaatctgcacggcatggggagaatacgtcatcgtctttgcataatcaaaatccgcacttgtatggatcacgcgctttgtcaccggctcctgttccggtggaagcacgataccacgctcctttagttcttcccctatgatggcaaaacttcgtttttcaatctctcccggaagaacatattcaatgttttccataacgtttttcttcccctttcttctttatatccagcaatgcctcaatcagttgtacattttccggatgaccttttacggcaattctgtaaaagtcctgtcccagtcctgtatagtttgcgcagtttcggatcagaattcctctttccagcaataatctgtacagtggaatttgtgttttcagcaacaaaaaattagcttcagaaggaaaaattttcatttgatctccaaatatttttgttaactcgtgttttaaaaagtgcttttcttcttgaatcagcccaatcgtatccttcagatactttctacgactccaaccaggaagcgaatcattcagaatgtccatgccgatccgctgcgcaaccacagatacattccactccggcagctgatgcgcaattttttcacagatatctttctgcgccagcagataccccagccggattcccggaatcgcatagatttttgtatatgcacgcaccacaatcagatgcggatatttccggatccaggaagcatatccttccatccccgtgaatgcaatgaaacattcgtccagcaccacagtgatgcgtctcttttcacacacgtcaagaagcgtctccaaaagagacgcttccattttgttccccaccggattcgcagggttcgccaaaaataataaaccgattccatccagatgcctgcacaatgactccatctgtgccatgtccatggcaaaattattttcttcctgcaacgggatactgtatacctcggcgcccactgtctgagccgcccaggcatatcccgaaaaagaaggagccaaaatgcccacccgcttcgggcgcagtgcatgcacaatcgcaacaaataattcggatgctccgttgccacacactacttcttctgttgaaaaaccataaagtgctgcaagccgttcccgcaacagcacattgtcatactgtggataacggttgctgtgaaccgccgcttccgccatccgtttctgcaatatctccggcagcggcagcggattggtatttacagaaaaatcatatgtgatctgattttgataaatatccccaccgtgtgcggccaccgtcatgctgcgtgttctccttctttcctgttttcccgtatctgcattactgctttacttcttattttactacaggaattctttgattccaagggaaaatcacacaaaccattttttattgtagatctccagccagctcctgcatcagatgatgtaccgtagtgatctcatgaatccgccccgtattcgccccacagaataccagaccgttttccacatccccgcgcacggcatcgatcaatgctttcgtaatacagtaaggaactttctgcggactgcatttttccagacagttgtaacatttactgactggcagctttgcgcgctttacacggtcgataaacttattacgcagtgcacgtcccggcataccgaccgggctttggataatctcgatattttcctcactggcgtgaatatacgcctccttgtatgcctccgatgcatcacattcttcggttgcgacaaagcggctggcaatctgcacaccatccgcgccgagatccagcgcatgcgaaatatctttctgatcaaatatcccgccggccacaatgaccggaatatttttctgataccgctgttcgtattcctttttgcagtcgataatctgccggatctctccgtcaaaattaatggcatccatatgtgccagctgttcattggaaaaccccagatgcccgccggctttcggtccctccactacaataaagtccgccgtgcggtcatagcggtgcgcccacatcttcaatatcagctgggttgcacgcttcgaggatacaatcggggctatctttgtccggcaggttctgctgacaaactccggcagattcatgggaagcccggctccactgataatcacatctgcccctgccgcaactgctgcctggacatgctctttgtaatgctttaatgcaaccataatattgacacccacaagtccgtttccacaggcaagctcctttgctttccggatatgttttttgatggcttttaagttacagcctgcctgatcattctcgaagccttcttcatcgtagccgatctgcgcagtagaaatgataccgacaccgccctcctttgccacagctcccgccagatgacttctgctgattcctacccccatgccaccctggatgatcggaatttttgcaatcagatccccgatctgcagttgtttcaactttgatgtatatgtgcttatcatgcacgtttcctccatatttcaaaattgtttgactatcaaacaattttcagtatatggcaatatagtttctttgtcaacatgtatttgttttcatttcttttatacgtagttttatttactacttccatatctgatatttgttctaaatgcaaaaaccgtgggtttccgatttcactgaaatcctgaaaacccacggtatccggcatgtcgtcttatcctttgacagcccccacaattccgtttgcaaaacttttctgcagaacaaggaagaggatgcccgtcggaagagaacagatgagtactccgagcataagcacaccgtaatcaatgctgtagccgctggagaggtttgcaaccagcatcggcatggtctgggaggaatcatccatcataataacctttggccataagtaattgttgcatgatgatacgcaccaggggcagatcggtcgggtcaagggtaagcattggtattcccgtcttttgatacacctgctggccgatctccatatagcgtgaccaggtcagattctgcatatcagcctcggaaaatcccgcctgttctaaaatatccagacggtaaaacagagccgctgttccacagtcaaacgggattccataggactttccatcatgttctaccagtttgcgtttataatccacatacttgtcataatccacacggtcatccagcgcaacaaattcctcttcataattttgcaacatatgatgcggcaaataccttttgcagttcttctcctgtttttgtttccccgagcagcaattctttgagcagttcctccgcggtttccccggtcattgcatgatccggatgccagccgggaatccgcgctgccgctttttgaagcacgccaagaagctcatgcggtgtgagggttggctttaagatataatccaccaccccctgcatgagcgtctgctttacatattcaaaattatcgtatccactgagaatgatcatctggatgtgcggatagcggtgatgtaccgccaccgtaaaatcgacaccgtccatcagcggcattacaacgtcactgataacaatctgtggctgaagcttttcgatctgatccatggcatctttaccatttgcagcttcccccatagtaaacattcccccaaaaacggtcttatcctctatcgtgcatttgccggctccacgttgaccgactttcctttgatctttacatttttcatggcttttaatacatcttttccatactcctgcggcacctcgacaaatgtgtaattatcatacatgtcaattgcccccacaagtttgcccggaatctttgcctctccggctacagccccgagaatatctcccgggcggatccgctggctctttccgatgttaatgaacagacgtaccatcccttcctcggctccggtatctcctgctaatgcatcatcaaattcgtgatcctcctttgataattccactccgccgattgcctgttttaaaaatgcagctgcaatatccatcgcggtataatcagagttgttcacctgctgctctatcagttcaatcatatcgcgcagatctccgtcctcgataatctgtccgatgccgtcaagaatcttatccgccttgatcgctgccacatcatccgaagatgggattggctgcgccttgatctttgtcttgcaatagcgctggatctctttgagtttgtatacttccttgcccttaacgaaattaaacgcttttccggtacggccggcgcgtccggttcttccgatccggtgcacataatattcattgtcctgcggcagatcatagttgaataccgcttcaacatcatccacatcaattccacgcgctgcaacatcggttgcaatcagaatatctgcttttccattccggaaatttttcatcacacggtcacgctgcacctgtttcatatcgccgtgaatcccctcagctgcatagccgcgcccctgtaattccgatgccagttcatccaccatgcgcttggtattacaaaataccagcgaaagctttggattataataatccagcaggcgtgtcagcacttccatcttatcatttctgcgcacatcataataatactggtcaatattcggaaccgtcagttctttcttcgtcaccttgatcgtagtcgcatcatgctggaattttcttgtgatttccagaatcggctttggcatagttgccgaaaaaagtacggtctgccggtcttcatccgggatataggataaaattgtttctatatcctcgcggaatcccatattaagcatctcatccgcttcatccagcacgatcgtgttaatataatcacagcgaatggttttgcggcgcagatgatccatcacacgccccggtgttccgatgatgatggttgccccaccttttaatgccttgatctgacgggaaatatcctgccctccataaatgggaagcactttgatcccatgcatatattttgcaagtttccggatttcttccgcgctctggatggccagttctcttgtcggagaaagtacgattgcctgcgtttttttattatttgggtccactttcatcaaaagagggattccgaaagaagctgtctttccggttccggtctgtgcctgaccaatcacatctaccccactcatcacaaccggaatcgcctgtgactggataggtgttgcctcttcaaatcccatctctttgattgcccgcagaagctgcggatataaccctaattcttcaaatttaactgtttccattttcatccttttctttttgccaggtttcgactgccatgccgttacaatgcggttcccatggtcacgtcttcagtttcatcaagcccccctacacaataattgttccggctgaatttcttcacccggtaaagcatattatctgctgcatgcaaaaaatcccagctgcggtttcccttgcgcgggattccccaacagattccctgcgaaatcgtcactaccggaagtgccttggaaaaccggtgttccatttctaatgtaagtacacgtctgcgcaactcttctgcaaaggaaacagcctgttcccgtgtcacattcgcatagataatgacaaactcatcccctccataccgtgcacagaatccttccgcttcctccaccagattacggatcgtatttgcgatacttaccagacaccggtctccttcctgatgtccgtaattatcattatattccttaaaataatcaatatcgagtatttccatcgcaaccggaatatcattctcctgcgaataggcaaacacctcttctgcataatcattcagacggaacctgtttgccatacgcgtcaacggatcctgctcggaacgctcctgtaataccatattctttcgttccgccttcattctggctttgcgcatattctccagatttttgcgcaacgtaatcatactcgaaagcatgttgcgcgtcactacttcgttccgttcagacaattcatagtaaagccctgccgcctgcagatattccgcattctggttatgcttccggtaaaatttcatcttcagggacagaactttcagatgcagattaatgatcttaaaattcaccacctgtggttcgattacttcaatgatacgccagaacgattcatcctggtccgtttccagcaacaccagacagcagcggtaataatccgaaaaaaagtccagcaccgtcagattatccggaagattctgatggatcatctgaatactctcattccgcttctgtacatctcccatcttgtgataataaattacatccacgatgtcgataaacagccgctctgtaagggcaacctgttcccagccatctttatgcagatactccagatatggttttgcttcctccagacgatcctgcaggatcagacattctgccatatttccataaaaagcatacatataaaaattatacttttcatccttctgttttgtctgcaaaatctgataagcttctaaaaaagaattctcggaatctgcataatgcccacactccagatacaataaccccatattgatcagaatcataaccttttgcatcggaagatcatatgtatcactgtccttaagaccattcatataatagtcaagcgcaagcgatggatttcctctgctcatggatgcgattcccagaaaattgtaacaacgcaccacaagttcccattcctctgcacggtccagatacgtcagtgcctctgtcatcatatggaaaaaatgtgctccgtcatttaattcataatagatttccccaccataaaagaaaccgaatcccatcagctttgaatcatctgtttttcgtccatacgctatgatatcccgacagcattccaacaccacgtccgcattggtttcccgattttccagaactgtatgaatccactgttgtacggttgtattgtactggttaaattccatattttatccctcttaagctgagatacctcttgattatgtacggttttttcgcataaagctccaaaaccgtttacattttattgtattagaaaaaactatgaatgtcaatccagcgtatccatcgccatctgcggaagatattctttcggatccacagcttttccatcttttttcagctgaaaatagacgttactgccttcggttgtataatattttgtcggctcactgacatatcccagcacctgaccagcttccggcgtatccccttttgcaaaattcagttccttcaactgtccgtaaaccgcagcatatccgtcacccagatcctgtatcaccgtacatccggtttcttcattttcctgaatatccgttatttttcccgttgccattgcaaacactttatcattgacattgccactgatcaccatggcaggattgcatcggtactgctctaacgtgggaaaataaatggtggaatccatgctgtaatccagaagaacatctccctcaattggccagaccgcagaactcttgtcaaaatgctgtgtcacggtggctgctgtctctactgttttttcttcgtcctgtttcttctcttcctcctgctgtgtttcttcctgtttcattttttcctgctctgccagctttaacgcctgttcttccgcttttttcgttgcatcttccacacttatttccggtttcacttcataggaagccggtgcctcctgctgggtctgtgccgcaatttcctgttctgcttccctgcgttcttttcctttatccgtggcatatacactgacaaatccaatcactcccgctaccagacacgcgacagtggctatatactgttgttttctcatttggcttacctccatcatcatttcgttttatggtctttgatgatagtatggactgcccgcgctgtttttatacagcactcctgtgatcataaataatattggagagctgtgcaaactgctctaaagaaagtgtctctccacgaatattaaccggtacgccaagttcctcaatacatgcctgcagttcttctttcggaagaccgaatgcaccataattggcaagcccgtttgccagtgttttcctgcgctgattgaacgatgcccggatcacctgaaacagcagtttttcactttttacggtaaccggcggctcactatgacgtgtcagacggataacggcactgccgactttcggctgcggcataaaacagcttggcggaacattgactacgatttccggttttgcgtaatattgcaccgccagagaaagtgcgccatattccttgcttcccggtccttcctgcatacgatccgctacttctttctgtaccatgatcgtgatactgtcgatcggcacatggctttcaaacaatcccatgatgatcggagtcgtaatgtaatacggaagatttgcaacgaccttgatcggttttccgttatttttttcttccgcaagttttgaaatatttacttttaaaatatcttcattcaatacatccacattattatattccgcaagcgtatcttttagaatcggaatcagattggtatctatttccactgccactaccgcgcgtgccgcctcacagagatattgtgtcatggttccgattcccggaccgatttccagcacaaaatcatcctttgtgatctgcgcagcttctataatttcctctaaaattcctgtatcaatcaaaaaattctgtccaaattttttctgaaaattaaactggtatttctgcaatactgcaatcgtattcttaggatttcctaatgtagccatgttattcctctctttctataatcgaaaaagagctgcctccgtggtttaagagacagctcttcgtttcgttttattatgtgattagccctgagagattgctccagttgggcaaacaccagcacatgtaccacaatcaacacaactatttgcatcgatctcgtactgagaagcacctgcagagattgctcctacaggacactcgcctgcacatgtaccacagctaacgcatgaatcagaaataacgtatgccataataaaatcctccttatgaataatgatcattattgccttattggcttaatggtattctagtacaaacccgtccaaagcgcaagcatttcggcaaatgtatttaatttgatgcatgatcataagaaaaattttatcgttccagatttgcaaacttcgtgtattccggcaaccatgcgaggttcaccgtaccgatcggaccattacgctgtttggcgataatgatttctgaaattcctttcagttcagtatccttgttataataatcatcacgataaataaacatcacgacatcggcatcctgctcgatcgctccggattctcgcagatcggagagcatcggacgatgatccggtctctgctctactgcacgggaaagctgggacaaagcaagcaccggtacattcagttcacgggcaagtgctttcagggaacgggagatgtccgaaatctcctgctgccggctgtctgtactcctgccggacccagacatcaactgcagatagtcaatgatgataagtttcagatcatgctccagcttatatttacggcatttactgcgcatctcggaaatactgattcctggcgtatcatcaatgatcagttcggaatcccctatgattccggctccttcgacgagtttcgcccagtcagcatccgacagattaccggtacgaagtgcctgtgcatctacacgggattccagggagaacagtcggtttaccagctgctccttcgacatttccaatgaaaatatcgccgtgcacatgttttcatgaaatgccacatactgtgcaatgtttaaaacaaacgctgtctttcccatagacggacgggctgcaatcaataccagatccgatggctgtaatcctgctgtccggtaatccaaatcaataaaccctgtcggtattcccgtaacatttccgtcctgctgtgacgctttttcaatcttttccagtgcgttcatgacaacctgacgaatcggtacatagtctccaccggtacggcttgacaacaatgcaaaaatatcatgttcggtcttatccagaacactttcgagcgattctttgcccgcatagcactcattctctatctcttccgtgacccggatgagtttccgcttcatggaattttcttttacaatattacaataatatttgacattcgcggatgtcggaaccgcacgcaccaattctccaacgaattccagactggagacttcctgtggtacatccttttccttgagtttattctgcagtgtaaccagatccaccggctgtccgctgctgtacaattcgatcatcgcatcaaagagaattccatactgcttgtgataaaaatcttcctgcagaaggatctccatggctgttacaatggcatcctgatccatgatcatggaaccaatgaccgactgctcggcttccagactgttcggcatcacccgcttgatcagcgtttcttccaagcgaacttcctcctattcctcaacaacctgaacacgcagtgttgcggttacctttggatgaagcttcaccggaatctcataagttccaagagccttgatggattcgcccagctgcatcttctttttatccagatccagccctgcctgctcttttgcagcctgtgcaatttccttggtggaaacagacccgaaaatacgtccgccctcaccggatttgatctttacaacaactttctttgttccgatctcctccgccagttcctttgcgtgctctaaattttcagctgccactttgtctgcatgctgattctgcaatttgaggtcattcagattctttgtcgttgcctctactccaagtttcttcggcagaattgcattgcgtgcataaccgtcactcacatttacgatttcgccctttttcccaagagctttcacatcctgtaataaaattactttcattcctgtatatctccttcttcaagcatttcatcaatggtccgcataatggcatgttttgcctcggaaatcgtacatcccgtcaactgtgcaccagccacattcaaatgaccgccgccacccattcgttccatgattaactgtacattaatttcatcaatagaacgtgagctgatgtatatttttcctgcgtactctgtcagcacaaaagatgccttgattcctataatattgagcagctcatttgctgcctgcgcgccgacaatcgttggactttccacgtcctcactcggacagacagaaattgcaaatgcaccgcggtatacttccgcatgacgcactgcctccgcacgggctttatagcatgccatatcatttcgcagcattttacgcacacgggtcacttctgccccggagcgtctgagatatgctgccgcctcaaatgtacggacacctgttttggtcataaagttattggtatcaatcaaaatacctgcataaatgcagtctgcctctgccggagaaagcttaaatccttcctggaaatactgtaaaacttctgctaccatctcacaggcagaagatgcgtatggctcaatataggacagcagcggattttcaatcacttcactgccctgacggtgatggtcaaatacaacaattgtatcggtacgcgtaagcagttccgggcattccgtataacttggacggttcgtgtccaccaccataacaagggaattgcggcttacctcttcaatcgcaatctcactattgataaacatgtcttccggatagcctttttccggagtaaaacattccataagcggccggatggaagttgttggctcattgatcacgatctgtgccttttttccaagcacacgggctgcacagaaaattccaatccctgcaccaagggaatcgacatctgtcaggctgtgccccatgataatcacgttctcacggctctcaataatttcatgcagcgcatgtgccttaaccctcgcttttacacgggtgttgcgctccacctgttttgccttgcctccaaaatatgcaatgtcctcaccatttttgacaacgacctgatccccacctcgtccgagtgccagatcaattgccgcacgtgcctgctcatagttctcgttataagaagtccccttgataccgacaccgatactcagcgtaaccgccatctcattgccaactttgaccgtcttgacatcttcaagtacactgaaccggtcgtccataagcttctgtaaatatttatacttaaataccacaaaatacttgtctttttcaattttgcggacaagcgcatccatctttgaaaaatactggttcactttcctgtcgacaagggcaatcagaagtgatcgcttcacatcctcgatactgtcaagtgcctcgtcatagttatcaatgtaaacaagtgccgatacctgtttctgatccagattctcctgtctgcagtgctgcagttccgtctcatcaaacagatacaatgccgtcaggaattcatcggaacctttcacatcaatttctttactctcctccatgatatcgtcaaaataaatacgattcagggaaatccggaaaatgcgctcctttttttcaattgttatatcctgtgcatcctcatgtttctgaagaaactcacgggtaatattggaaaaaagggttgtaattgatttatgatagtttctccccactcccgtcagttcggaaaaacgttcattcacccagagaattttccccgtataatccagcagcgcatatggaatttcaaactcattcaaaagttttttttgtaccgttgcatactgtgtggcaaaattgataatttcatttgcaagccggggtctggtattataatataagcccagttccagtacaaaatagacaacaataaataccgtcagcaaaaagcctgccgtcacatcgtaaaaataaagccccacatctgcgagtgtcatcgggatcgtcagccacaatggccagcagagatatgatctcagttttcccttaaaccgaacctttgatttcatttacgctcctgttctttccacatcatcgcccaactgtggaatatacccccacatcaataatttatagtataacattttccctgtgcaaaataaagaccttactgagataacaaaaactgccccattttcatggagcagtttcgtccaatgcatcacagatgtatctgtgttatccgttttcttttgcaatttccacaatggatttgctcagtcctgcaatcccctgaatatccgatgggataataatcttggttgcctgaccgtctgctgccttggcaaatgcctccagactcttaatctgaagtaccgcattatccggagcagcttctttgagcatacggagaccatctgcattggcctgctggatctttaatgtagcctctgcctgaccttcggcttccttgatggttgcttccttctgtgcctcggcacgcaggattgcagcctgtttttcagcctctgcatcgagaattgcagactccttatttccttctgcaaccagaattgtagattttttctcaccttctgcacgcagaatggcttcacgccgctcgcgctctgccttcatctgtttctccatggcatcctgaattgcctttggtggaataatgttctttaactccacacgatttactttgataccccacggatctgttgccacatccagcgttgcacgcatctttgtgttgatggtctcacgcgatgtcagtgtctcatccagttccagatcaccaatgatattacgaagcgtcgtagcagtcagattttcaattgccatgattggattttccacaccgtatgcatacagctttggatccgtgatctgaaaatatacaaccgtatcaatctgcattgttacgttatcttttgtgattaccggctgtggtgggaaatcaaccacctgttccttcaacaaaaccctttttgcaatacggtcaataaacggcaccttaaaatgcaaccctaccgaccatgtggtaagataccctccaagtctctccacaactaccgcatgcgcctgtggaacaattttcacacagttcacaataatgaccaatgcaatgatcactataatgagaattacaacaggcataactttttcctcctttacctataccttttctactataagtttgacaccactgattgccagaatttttgcttcttctcccggttcaatgatctcattatcattacgggtacgcaccgtccactcctgtccatgaacaactgccatcccggtctgatccatattactgacgcgctcggaaatccgtatattttccccaatcaggctatccgcgtttgttctttgcattttagcatttacatatttacgcgcccacggtcttgtcgcaacaagcaaaagaatggataccacgaaaaataccagaaactgcaccaccggatttacccctgccattgccataaccagtgccgcaagtgcacctgcggcaaaccatatgcacgttagtccgattgttgcaagttctcccagaacaaacacaatcaaaagtaccatccaaagcaattcatacggatccatcgctcttataattatcatagactctccctcttttctgccacttttttattttggcgaatgcacagaatacataccggcattttccatccggatcacaaatgcttttgcaaacccggctgcttttgcataatgctgaatctgtggctgttgcaccagttttatgtcccatccgtgcatctgcacgatttttgacacgatggaaagtccaagtccgtttctcccatcgcttacccgcgctttgtccccacgcgtaaaaggatcaaacaaatgctgcgcctgttcctctggaattagaattccgctgtctgccaccaatacataaatccgctccagctccctataagcaaacagcccgattcttgttccctttggattgtgctgcatggcatttgtcagaaggtttgtcactacacgggataactgaagttcatccgcccagaccggtatcgtttcctccggaatatctgctgtcagtgtcattccgttttcttccatctctgcatacagcattgccgcattttctctgagaagttcacacaaatcaagcgtttttccatttaatgcaaacccttcactatccagttttacatattcaaacagcaaattgatcagatttccgatccgaaccgatttattctggatggcatccagatattcctgctgtttttccggttcctgtaccatatgatccgccaatgcttttgcgtaaccggatacggtcgtgaccggtgtccgaagatcatgtgcgatatcggaaagcatcagattccgcttgcggtcaaactctctctgctgctgttcgcgctcctcctggatctgatgaaactccgccatcacaatccgcgcgaacgttatcgcacccaaaatataaggaagcagcatacacaccattaacagcagaagaaccacaaacagcaggatggctttccatccttccatctcctgtacgacgacggaactccttgtcgccggaagtgcattgcccagccagtcctgtaacctttcccctgtccactgcatcattccctgcagcggtgatggcaaaagcatccggacggcatttactatcagcaataacagaacacatatgataaaaataaacagatccgtctttccaacggatgactgcctctggtaatccgggaaaaaaactttcatcaccacaggcataaccgcctggctgatcaaaaaactgatcagcgactgtgcaactgtcaccagtacaaggatataaataaaccgtttgatcaaaaatgcctgtaaatcacgcattgctatttctccagccgatagcccaatccgcggatggttcgaatataagctgccgggtcttcatcaagttttgccctcagcttgctgatgcagaccataatattattgtctgcaaccacataagtgtcaccccatccctgttcatagatctgttgtttggtaaacacttttcccggatgcttcataaataactccatgatccggtactctaccgaagtcagttcaatcggttctccattttttttgagtacgcagccttccggatccagttccagatcccggacggtcagtatattggatgacagttccgctgtccccagcgcataaaaccgacggatatttgaattgacacgtgctactgcctccaaaggattgaacggttttgccagataatcatctgccccgagatttaaccccagaatcttctcggaatccgcatcctttgccgaaagtatcataacgggaatattgcttgttttacgtaattcctgcaacacatggtatccgtccatctccggcatcataatatccagcagacacagatccacatgttctttctttagcagttccagtgcctgcttcccgttttctgcctcaataatctgataattttcattttccagatacagccggagaagcgttcgtatctccggctcatcatctgcaattaaaatcgtataattcatacattctcctgccggaaaggtgaattcaccggatccgcctgctgtgtaaatccgtttgaaccagccgggtttgcatagcacagtgcctcatacagtgcggcatgtgttgcattcacatatggtgacacataaaagattgcaagaattccaagtgtcagtccggataaaatgtaccatccgataaaggacagatccaaaacaaatgctttccatttctgtccctgcatcatacgcttgctttccgcaaatgcctgctctttggtcatctgcgggttatctgccagaaggtacggaatcatcatatattcatatgcttttacaatacccggaatgataaaaagcaatgaccataaaaccgtaaacagatcacggaaaaacattgtctttgcaacattcctgtaattattgtcaaatccatatccaatgttcccaatctgtgccggctcatttaagttgcggataaagaatctcctgcatccaacctccaacggatttatgataaatacatcaaccagaagtataaggacaaaaatcaccagaaaaacaactatgagtatgccgatggcgatcgctgctgcgaccataccgcccatcattcccctgtttcctgctttcagtccgtccttaaagccttcttcaagcccagcctcaaaatcgcgtagtgaaccatcatcactgtcataactgctgtcataatcataggaactgcctgcctgattatccgatccatgtaaggaaccggttgcactgctgatgttgcccgaagcagctccgcttccccctgcaatcagtgtcagcaacaggctgatcagaatacatttccaataatttcgtttaaatgttgctttcgcccttccctttaattgtgcgcgactccacatatcaaattcctccatttccttttgatgatatcatcataacaccaaatccttatcttaaaaatcgctgcaccttaacgttaccttaacaacgtgtatttaatttgcctgtttcttcttcggcaaaagaaggctcaacagaagggaaacaacaaacactcctgcgtaaccagtccgacattctggctgaacaatgtcagtggcaggcatccaaaacatccggaaattgcactggaaaatccatccacggcaagtgagccctgaagttcctccattttaaggtcacgtccaagtgctccggtacacacagcagttgtcgcaccagttgtctctgctgctgaaaaatcctacctgatcaatggtctcctaaattccggagaaatccaccataggtgcaatccctgcaaccgtaaatataatagaaagaatatatccgaaaataagtcccaccagaatattcagattcttataaacaccctttaacacatatcttgccaccaggcacacgataagggtcagggcacctaccagcagatgataccatgccccgaaccagagctgcactgcagacgatcagtacgggtgccagatttgctacaaacatggcaagcacatgttgaaggccaaacggaattgcttttctcatatatagacaaagacagtttatcatcttattgcccatagtgtcaaacaggatttcccggttgcggtataattatcatctgtgctatactatgaacaattagcgtgtgaaagcgtacaaaagaggaggatttatttatgacatctgcacaaatatgcatcatgattgccattatcgtataccttattggtatgatctatattggtttccgatgttccaagaaaaacaacagtactgacgatttctatctgggtggcagaaaactcggtcctttcgtaaccgcgatgagtgccgaagcttccgacatgagcagctggcttctgatgggacttccgggcgttgcttacctcaccggaatttcagatgccggatggacagcaatcggactggctgccggtacatacattaactggctgatcgttgccaaacgtatccgccgctatacgcacacctgcaacaattccattaccatcccatcgttcttcagcaaccgctatcgcgatgaaaaaaagatgctgcaggtcattgctgctatttttattgttatcttttttattccttatacggcctctggatttgccgcatgcggaaaacttttttccagcttattcggggtaaagtatctgaccgccatgatcatcagtgctatcgtaattgtggcatacacgacacttggcggatttcttgctgcttccacaacggactttatccagagtatcatcatgtcggttgctctgattgtagttctgatctttggtgtagaaactgctggcggtatcggtgccgttatccacaacgcctccgagcttccgggatatctctccatgacactttcctatgatgtaaacaccggaaaggccgctccttacagtgccctgaccattgtttccactgccgcatggggacttggatatttcggtatgccgcatatcctgctccgctttatggcaatcgaggatgagaaaaaactgaaactgtcccgccgcgttgcaaccatctgggtcgtaatctccctgttcgttgccgtctttatcggtgtgatcggttataccatgagcaaagtcggcgcactggagatgctgaccggatcgaattccgaaaccattatcgtaaaaatttccgccctgctctcccagcacggtgtgatatttgccctgcttgcgggtgtgattctcgccggcattttagcttccaccatgtccacttcggactcgcagctgctggctgcatcttctgcggtttcttccgacattctcggtgctttccgcaaagattcttccaacaaaaacggaagcatggcagccgcaagaattacactccttgtaatttctgtcgttgccgcattcattgccagaaatccggacagttccgtatttgccattgtttctttcgcctgggctggattcggtgccgcattcggaccggttgttctgttttccctgttctggaaacgtaccagcaaatggggcgcacttgccggtatggtctgcgggggttccatggtatttatctggaaatacctgatccgcccgctcggtggtatctggaacatctatgaactgcttcctgcattcctgattgcctgcgctgcgatcgtaatcgtcagtctgctgacaccaaaaccttccaaagaaatcgaagaggaatttgaccgggtcgcacagatgaaataaatcttttaactttgtataccaaaaatgtcggtagatatctgacagatatctaccgacatttttaattcttattttcaattatgctttgatcctagcggcggatctttacagacttcacactgctgtatggactgtaatactttgttccatctacagtaacatagctgcggatcttgtaataataagttcctttggtgagttttgcccttgtataagactgcatctcaccatcttttgtagccgcaatcttcttgtatccataatcatatgctcccttggagcggtagatttcatagccggtaacggaagtacctggcagccatgtgatacggacttttgatccgtgtgcacgcaatcttgtgataaccggcttctccggcttaataataaagcttgtctttgcagatcccgtataattaccggttcccactaccataacagcagcttttcccggtgcaccattgtcactataattcagatagtaatccgaaccttcttttaaaacaatgttatttaatgtaacggtaacttccggttttacggaagatcccgtataactttgtgttgcaattttgctgatcactgcatttgcaagattattggatgaaaccgttgtatttccgtttccatgatttacaatacggaaataaactgttctgcttccataataatttccgattccgttaattgttacggatgcagtaccgatattgcggttgttgctgtaagtaagtgtataatctcttccctcgtacagatagccgccattcagccataccgatacagacggacgaatatcatatccggtgtatgtctgatcaacgattgtacctaccgaagcatttggaatatagtacgaataggtattattgctgttattggttcctgttacctgaaccggaatctgcagaggaattcttccatccggacgattcagtgtaagtgttgtggaacctgcagtatttgcgatcagttttgttccgctgatataggcaaccgcagtattggatacatacatattcagtccctgtacaatcggacagtttgcattgcttggccagtgattagatactttaatgttttcatagcatccagataaatcaatggtctgacccgcagacatctgaatgtaatttccaatggatgacggaacaacaatctgatctgaggtaatattgctttccgcaatctgaatattgtttaccgttgtcgtctggttgttcggtgttgtataggatgttctggttaccgtgttggcaaattcctctacccagtagtggtagccattgtaatatacatgtccgattccgacagctgtaaactggctgtttaacatatttctacgctgttcctgtccggaataatttgcattgtcttcccgcattgcgttgtgaagtgcagatgcggaagaataattcacaccgatattctctgcatacactcccgcatagacaccgttttcactgtaagcagtataataatttgtgccatttggtctggtgtgtgaatatgaaagtgcaatctctgctgcacgtttcatggctacttgctccaatgcatagtcgtaagtaagcgactgcagattattacaatatgtcttcgtgtaattgtttgcatcccagtaccatgcatcggatgaatttctgcgcatactgttgatcatgccatagacgtttctggcatccgtctgtccgtatgtaacctgaatacttacgttccgtgtaccggttgttgcagccatcacattgcccgcataccccagtggaagcagtgaaacaatcaggacaaacgcaagcagacgcctgagtacattgtgcgttttggtttttctcataatcttgatcccttcctttattttaaaattttgttatccctattgtacgctttttagcggcttcccgcaatgataatttcataaagtttgcttgacaagcataacagaaaagctatactctaattagcaaacaggtgggtgcgcaactcgtttctgcgggctgtcgttttgtcggggacaccgttcgcaatttctagtctgcctaagagggaatcttcgaaacgtttattacgcccactccccatttgtcttgatatttactttattttcaatatgtcactctgtgactgcgcaaatagaaccgtgggcatgcttgttcgaagcttccctctaaggcagacacaaaatcgctcagacggtgtccccgacaaaacgacagcccgcagaaacgagttgcgcaatcaccaatctaattagcagatggagaagggagaaataacagaatatgacctatcaggaattagtttcaaaattaaaagatacttatcaggagaaagatgcttccaaaatcagcgaacatcttgccatccagtttaacatacagggagaagccgaaggtgccctgtatctggaaattgcaaacggacagcttcatgttgaaccatatgaatattacgaccgtgacattttagtcacaacttcagctgctgatctgcttgcactcgcgcagggcagccttgacattctcgaagcttaccagagtgggaaaatttctgcggaaggaaatcttgcaaaagcattgctgttaaatgaaattatcaccggttcatccgaagctccggcaccagcagaatctgctcctgtggaaacttcggcaccagcggaatctgctcttgtggaagctccggcaccggaagaatctgctactgtggaaactccagctggcgaaaatactccggctgcaaaaccatccgttaaagcaccacgcatgtcccggaagaaaaacagaaaaagacataaataatctgtaaacttccttgtgtttttcagacagcatgttatgataattcataacataaggtttttgatataggaaaggagtgaaatatatgtctttttttaacaacttaggacaaaagatcagtgatgtgagccagactaccatcaaaaaaacaaaagatctggcagatactgcaaaattaaatttaaatatctccgaggaagaacgcaagattgatactgcatacgaacagattggaaaatggtatgtggaaaaacatcgcgaagatgccgaagaagatgtaaaaacctggctggatgcgattgccgtttccgaagccagaattaaggaatgccgtgaaagcattcaccagatgaaaggtgtagcgatctgcccatcctgcggtgcaagcgtggatgccgatgctgcattctgcagtgcctgtggacagaaaatgccggaaaagccaaagccggaaccggttaaggaagaggatgtcgaggtgattcctccggaacagccgtctgaggaaccagcttctgagaccgtgtcggaaaatgcttccgaaaaccagaccgaagcacctgcatctgatgcttcaaccgaagcttaaaaacagacatggaaaacaaaaggagctgtcgtgccgctgatattcgctggtgcgatagctccttttctaattttattaaaacgagttgcgcaatctctactgtttatataaacgggttataaaaccggctgccatcatgatatgtaatcacaagtgcagccacggcaaatccaagcaccagtgcaatacacagataatcattgcgctgtaactttcttcccatataccaggtacgctttttgtacttcccatacccacgcagctccatcgcattactgattgtatcaatgcggccgatacttgtaaaaataagtggaaagatgatagatgccgtactctttatacggctcatcagctttgccttcccggacatttctattccacgggcctcctgcgcatttttaattttgtggaaatcatcctgcacatccggaatataacgcagtgcaattgccaccgcatatccgatgttgtaactgattccaatacgatttaacgatgctgcaaactccgacggattggtggtcacgacaaaaataaataccgccgggataattgtaaaatatttcaaaataatgttcaactcataaaacaactgctcagcggtaatcggataatgcgccgaaagctgccagagtacatgctttgtaccataaatttttgttccctgatccggtgcaaaaataaaaatggcaagcacattgatgaccagaaagaacataatgaacttaaaaatagaaccgacctgtttccactctgtttttgaaatcttaaacaggatcagactaagaaccagcatcacggcgagtacacgggtatcataagtaagcatgcttgtgatggaccatgccagaaaatagatcagctttgtgacaccacacagccggtccatccaggtatctttttgctcataggtcaataactttgccattaccgcaccgccctttcgtaattgataaaccgctgcacgaactgggaaggatcttcaattccacatttgaccgccatctcatagagtgacgtctgctttaaatatgccggagctgtgatcgtttcattggtcaatacttttgccggcgtatcaatggtcagaagttttccatctgccacaacaatcgcacggttggtatattccagcatcaggtgcatatcatgtgtaatcatgataatggtcgtcccctgtgtctcgttgatcgtctttaaaaactccataatttccgtataatggcggtaatcctgtcccgctgtcggctcatccagaatcaggatctccggcttcataacaagaatggatgcaatggtcacccgcttcttctgaccgaaactcaatgcagaaaccggccagttccggaactggtacaatccacagattttcagtgtctcatgcacacgctcacggatttcttcctctggaactccgcgcacagtaagcccaagtgccacttcctcataaatcataggcttagaaatcatttgattcggattctgcatgacaattccaatatgctccccacgctctttgaccgaaagtggtgagatatcgtttccgttcagctcaatttttcctttgctcggttctaaaaatccacagatcagattggacagtgtcgtctttccggcaccgtttttcccgacaatactgatcatttcgcctttctttacatcaaaactgatatccgaaagaattgctttttccggctgataagaaaaatgcagatggtctactttaagtaccttctcctgtgtttcctgtttctgcggaatctgcgtagtctcaaaccattcccgcacctgtgttttgtatggttcaaaattcatggtttccacatgctgcggatgatcctgtgcagtgatggtacatccggcatgtttgagtgccgtgacatagagcggttcccggattccctgttcctctaagatatttccaaccagcagatcatccggtttcatgtccgcaacaatggttccgtctccgaccacaacaatacggtctacatctttgtacagcacatcctccagacgatgctcaatgattacgatcgtttttttctgttccttttggattctgtcaattaacgcgatcgctttctttccggtcgccggatcgagattggccagcggctcgtcaaacagcagaatatccacatcatcaatcataacccccgccatggaaactctctgtttctgtccgccggacatctccgatggtgcatgatgcaacagttcttttacctctacagtctctgccacaccgtctactttgcgaaacatctcttcctgtgccatacagtcattttccagcacgaaagcaatatcttccgcaaccgtcagaccgataaactgtccgtccgtatcctgcaacacggttccgaccatcttggaaagtccgaaaatcccaaggtttttcggatcttttccctcgatttttaaagttccggtactgtctccttcatacgaaaaagggatcagtccgttgatacaatttgataatgtcgacttccctgatcccgatggtccaatgatgagcaccttctctccgggataaattttcaaattgatatcccggagtgtcggctccatctgtgaccgatatttaaatgtaaagttttcaaattcaataatcggttccatacgtttttagtcttcctttgtaagacttgatgattttgctccaatctttgtatatcccagtccgagtaatgaaccaagtacacccacaatgatgatattggctacaaacgcaaatacgccctgtgagaatactttctttgcaggctctgcataaatgagaatatcaagcaccggtgcaacaacgatccatgcaattgcatttgcaaccacctgaacgacattaaaaagaactactttcttcttattaaacccaccggccttaatctcaaatctctttgcgaataaaccaactaaaattccaaagatcgcatctgggaatacccagctccaccatacaccaccgtaaaacagtgcatctccgagtgcatgtcccagcagaccaatgattcctccgacaaccggtccaaacactgctgcaagaaatgccagcactgctgcacgtggctgcatggatgtattcgggataattcccagcggaatctgcacttctgtcaaaacaatgaacaatgcggttccgataccggttgctacaacttctttgattccaaattttttcataacaagttcctcctttgttttttcagtaccttattatttatgataaacgcacaaatgtcaagtttttcgccctttttctttccagcttcccctaactttttgcaccttctccggcaaagtattccttcaccagtttaacaacgacaccggaaagcaaaaatactgcgatcaggttcggaattgccatgagtccgttaaacgtttccgcaatactccacatcagacccagatccatggtcgcacccacaatggcaaccagtgcatacaccagcatgaacggcttattgacacgggagccgaacaaaaactcgatgcagcgcgtcccgtataatccccatccgataatggtggaaaatgcaaaacaacacatcgcaaccgcagtaaaaatagatacccagtttccgtatgttgcggtaaatccactgatggtaagttctgctcctgccgcctgtccgtaactgaccggaacctggctgcacaaaataaccagcgcggtaagcgtacagatcacaatcgtgtctacaaacacctcgaaaattccaaaaaatccctgcttgaccggttttctcgtgtctgcacaggcatgtgcaattgatcccgtgccaagtcctgcctcgttggaaaaaattccacgggatacgccctttttcatactcatgaaaaagctgccgaccgcgccgccggtcactgctgccggatgaaatgccccttctataatggaagcaaatactgccggaacatgaccgatattaaataagatcactcccactgccaaaacaatatagattaatgccataaacggtaccagcttttctgtcacccgtccaatccgcctgatacctccaagcagaatgagtgcgatcagaaccgccagaatgatcccaaccacaagattaacagtcggtaccgcatcttttgaaatgacatgataattcattaatgccgtattgatggctgtggtaatcgtatttacctgtgtggcattccctgttccgaatacggtcagcacgccaaacgcggaaaacagatacgccagccagtgccagtgctttttgagtccgttcttaatataatacatcggaccgccgaccagatccccatgcacatttttttcgcggaaatgcaccgcaagcgtcacttctgaaaacttggtacacataccgagaattgcggaaatccacatccagaacacggctcccggaccgccgatggcaatcgcccctgccacaccggcaatatttcccgtgccgaccgttgccgcaagtgccgtacacaccgcctgaaacggtgtcatggctccatccgatgcctcacgcttcttaaacatgcggccgaaggtcactttcatcgcgtatgggaacttgcggatctgtaagaaccgggtccggaaactcaataccagaccaacaccgatgatacagatcattgcaggaacaccccagatgaaattgttgaccgcactattgattgcttcaattgtggataacatacgtttctttttccttcctacgtgaataagcgcgtgttttttgtaaaacacgcgcttgcattatagcacaatttttgcattttctctacaatggaattgtggaagaggatatttcccatggaagtccttacggtggtccttattcccccgctcgtgcagccgaccccaccactttctggccttatcaggtatggtcctatcaggccgatgatgcctcctacacccaaataggttttgtgaccgactggaataaaaaagaatgggcagacagcattgacggattttcctcatttccggattccgctgataaggatcacgacggtatcgtatatctcctgacaaatgccaaagggaaaaaaaacgccatagatgctgctgacctgaaaaagtgggtggattcctaccgtaaaggtgcaaaagaaattcccatcacctatcaaagactcaaataatggcaattatgattgtgtatcaggatcactgactgcgtaccgcccagcgcatcttcgtggagcgtgcccgtccgttcttcgcacactcctgcgcggacggacgcaccacatcctttgcatactccgaataaatgcctgcgcgacagccttcttttaaagcacgctttaccagcttgtcctccccggaatggaatgtcagaatcgccacgcggccgcccggttttaaagcacccggcagcttttccataaattcataaagcacctcaaactcgcggttgacatcaatgcgaagtgcctgaaacgtccgctggcaggtctttttgatggtttcttttttatccttttccggcagaaaatcgagagtgtcttcaataatcctgcgcagttttgtagttgtatccacgcggtgtcctttgcggatctcatcggtgatcgcttttgcaagttcctcacagtacggctcatccgaattttcataaagcattccggcaagctcgtcacggctgatcgtatccagacgctccgccgcactgattcccgcctcctgattcagtcgcagatcaagcggtccgtccactttaaaggaaaatccacgctccggattgtcgatctgcatggacgaaacgccaagatctgccagaacaaaatcaaatccacccacttcttttgcaatctcatcaatcgtgcagaaattctgcagatggatggtcagcatgtcctctccgaatccctggtctgccagacgttttttcgtctttgccgactctgccggatcgacatcggtcgcatggatgtgtccctgtccctgtaattgttcaagcatggcttttgtgtgtccaccgtagccgagtgttgcatcaaaaccggtctgtcccggtttgatctgcaggaaatcaagaatttcttttaccataatggagatatgcatgcctgccggggtgtttcctttctggatgacatgcgcgatcgtgtctttgtatttttccggctgcagttctttatatttttcttcaaatttcttcgggtattttcctttataatgcacacggcgcttgtgcggggtctggttttcgttttccattttttattcctttcctctcctgtccaggtacagctcctcttaccatttgcaaggcaaaactttatatgaggttgcgaaggtattatttgcagagtaatctttgagcactaatgatttcaaatttaatctgttttctatgaataccggtacaattgtttttctaccagtttacttccttcataaacaagccgaagtgtaaaaaagcggtgctcgtcttcctcgatcagcagttttaaaaaaatggcatctccttcccaggtcggaagcgcaagcacttcttttttgtccatccactgcagatcgccttcattgcactcgatcagctccccggtaaaaccatccgcagtaaacaggcacatttcttccggctccggcgcttcatcactgatgaatgtgatcagcccgcggaactggtaggaagtcagtgtcaggccggtttcttcttttacttcacgtaacaggcagtcctccggtccttccgtgccttctgcatgtccgcctacaccaatccacttgtctttgttgatgtcgtgctgctttttggtgcggtggagcatcaggtattttccgtctttttctatgtaacacagggttgtcattttcatgggattttcctcgttatttctcatatttgttccatatgctccatgataacaaaatttgccccgttttttcaatcaaacatttcatattttgccccgtttttgatatatttattttctttttttgccccgtttttaaattccagccgagttatggtgctcatttgaggtattctccaatccggtcaatattataaagcggggtgtttgtcatccagtcctgctcacggaaatccgacatggaagtccgcaccgcatgcttgggatgatacttttcacaaaaagcccgcagactttttgcccgcagattttcctctgctttcacctctaccagaatgaccgatccgggtgcctgcagcgtgaaatcaatttcgcctgtagaatttgccgttgtgtaataatatggttccacacccagttccgctatcatctgctgcagcacatactgctccgtcaacgcccctttaaactctgtaaaaatcctgtttccatcaatgataacgcttgcatccagatctgtcatggcaagcagaagcccgacatcaagcatataaattttgaacgcatacagatccatgaaatcaactttccctaccggaaaagaagttcccttataaaacgtttcattgtgcgtcctccctgtcagtggaatttatatgtagcattccttattactttatatcatatttctttatggcagagccgtcaacatttttaaggacgtatttgtgttatggtgctacacttttcaggacgtatttatgtgatagtgctacacttttctggacgttactgtttgcataaatgtggaaggtttttgttgcatctcaggcatttaaatgctatacttgtcacaaagcaaatacatatttttccatagcttgggcggacagtacctggcgagccgtctatatcatatattttattttttcatttcaaattatcccggaaagtcttgcttttaaaattcaactttattttaacttaattttgttataagcaggatttgtattgatatgggatgtgttgtcatacagattctgtggcttacacaaggaggaaactgtatggcaaacaaagaatacaaaagtgatgtgttcagcatgcttcttcaggacaagaaacgtgcaatggaaatttataacgcgattaatggaacggactatgatgatccagaactggttgaaatgacaactttggatgacaaaagcttttcgcttaccgtacggaatgatgcatcattcattcttgatgcgaatctgagcctgtatgagcatcagtcgacctattgcccgaatatgccactgagggatctgctttattttgcaagcattatacaaaaacaaatcaaagctcagaaacgtgatatttatggtggaagaatcttaaagattccagtgccccattttgtcgtgttttataatggaaaagaagatgcgccggatcagtatgatctccgtctttctgatgcatttgaaaaagaaaccaagaatcctgagatagaattggtctgccatgtttacaatattaacaatgggaaaaatgttccattgctgtcaaaatgccagacattgcgtgaatatatgtattttgtggatatggtgcggaaaaataatgaaatcagtggaaatctggaagatgccattgagaaagctatcaaccagtgtatggaagaaaatgtgcttagggattttctggctcaacacagggaggaggtaatgcacgtgatgacattagactatacatttgaacgacggctggaaatgcagcgcgccgaagcaattgaggatggcgaaaggatcggaaaagaaatcgggaaagagatcgggaaagagatcgggaaagaagaaaaattgtcagagcagattcgtaaaaaaattcaaaaaggcaaacctctggatcagattgcggacgaattggaggaagtgccggaaaccattcgtcctttatacgaaaaaattaagcaggaaatgctgcaataaaataaggcagtttttatttaatcacatattttaacgaggcatctgtatcctcatttttttccattaccagcacccagttatcctctagggtatctgggtcgagcggtatgatatcgtgtgcattatccccagcctttactttatattcataagaaagcgattcattatccttatcaagaaatgtcactttaaattctccggaggtcgcttttacatcaacctcaatttcactgtcacccttttttaattccagtggatcttccctgtgtttcttttccggtgtataatcctctttatacacatttatctcagattctttatctatatgttcttttccgcaggcaagcagacccattcccatacaagccactgccagaattatgattgctttctttttcatgcaatttcaccatcctttatcgtaatcaccctgtcggcaaactgcgcgacttccttatcatgagttacaactataactgtttttcctaccttattataatctttcaaaagccccataagttccatgctggttgcatgatccaaagctcctgttggttcatccgcaagtatgatatccgcaccacttacaagtgctcttgctaaagcaatcctttgttgctgcccaccagacatctgctttggtttcttattcagttgatcctcaacctttagttttcctgcagcttctctgatcagtttttttctctctgcacggcttttctttgtatgtaacaatgggagttctatattttcatatgcactgtatttatccataagggcaaagttctgaaatacaaaagtaaccttctcttttcggattctgcataactgcttttcactgtaagaactcacattaactccatccagcaggtactccccttctgttgcccggtccatggctccaattatgtggagtaatgttgattttcctgagcctgatgcccccattattgcgacaaattccccctgatctattcgaagggagacatccttcaacgcaaatacttcattctcatttttaccatatctttttgttatgttcttaagttctatcattcattttcctctctgatcaactgtaccagatccagtctgttaatcattagaagtggtggcactgctgataataaaataaataccattattaagactgcaacaattggaagcgcataatttctcagggtaagtctgtataaatatgaaaatgcggaagccccagccttatatgaatgatcaacagcaacgtatgcgattactgccataattgaaagaataaccagaatttttccgatcatatttgcaaccagtcgcatttttgattctccaaaggcaagccggattccatattcccttttgtttataagaattgaagtgcagaacatggtacttacggacatgatggagcataacaatactgtgaaagcaaaccttccctggatatccagtctttctttgttctcttttttcatggtactgaatttttccgcaatggaagtaagactgattttcaaatttttatccgatgccagctgcaatatttccggaatcttatccgctgaatccatttttaaatatattttattcacggtattcaactgcatattataatcggagatctccttgtcgctaaatgaagtcagaaatttatagttcatatccgatacaggaaatgtaaatgcatctgaactgtcaaaccagtttacatcatccagatatccttttacaatatatttattaccataataacaatccgtcaggacatcatttaccttaataatatccttataccctttccctacgaaaagtggatagaatttctctccaccctttgaaacaggttccagcatgtcctttgtgattccaacatctacaaaattaagcatatccgtatccatgacaatcatatctgagcagtcaggcatatccgcatagaatgtatccttaagtacattttcattacattttaaatattcagcatttgttgaaagttcatcaaaggaagaccaggtttcctcatatgcaccacaggatatgtgatagtcatttctaatcttctcctttattgcatttatatcctctgcaaacgaagcctcatcttctacatagctgaattccattacataggttttatccaggtcagatgaaaaaacatctctgatttcctgcatctgctcataaagtgcataattatttgtcaaagcaaaaaaacaaagggagaatgaaatgaaggacagcacagccccgatagtaatcagccccttatttcgcaaaattccatttatgatcttcattaatttttaaccccttctgccggatggattttcagaatatactttactggtaatatgcctgaaataattgaggctatgaaaaccattcccaaatacataaacatcatacgaacggaatcaaggccaaactgcatggtacctctgcatatctgtatcgtaatctgaaccagcgctgctatgattgcagctatcccaataatcaggaaaaattcttttatgagcatcaaaataatttccatattcgtctgcccgaaagcctttctaattgcaagttccctcttcctgacatttatccaataatacgaaacaattgttacatttataaccgcaaacaaatacaaaagtataccaagaatcgtctgttcattttcaaatccactcaaaaccgattccttattttctacatctccataggaaatactgctggctggatatttttcttttaatattttttcaagctgactgtataccgtataaatattatccttattggaacaaatccttaattccagtgactgcgtttcattttcatcactgaatacatccgtaaatgtacgtgcatttaacacaaatgtatcttcatatgccgcacatttagcagtatctatttcatcgcatatagctatttttttattatgaacattcagcgtggtattcttaaaggaaatattatcaggaacaattatttcattttcaccaggtttctttacattattttttaatggatatggcagcctctcattctggcataaaattacgtccggcttgaacacatccccattttcgtcatagtaaaatctcagatttttcagatatacgttacattgcttgatatctttacacatatgcgtcaaatctttaagattgattttttcattggaatccacatatgcacttaccatatgtgtgtatccatatctgatttctgctttgcaattatttctcgcctctataatggctgaaaagccattatagagggcgaaaaaagcactcagaaaacataatattattacgactgaaacaactttatatctttttaagaccatattatttcactttctcttttaagtttattgtgtcaggcaccaattgttccaatgtaaaacgtttcatcgtgcgtcctccctgtcagtggaatttatatgcagcatttcttattgctttatataatattcctttatggcagagccgtcaacattttcaaggacgtatttgtgttatgatgttacacgtttcaggacgtatttgtgttgtcatatcacacgtttcaggatatgattctatcatgaaagtaggaactataaacttacaaagtttctgcttttgcaaataaccggtatgctcttgcaattttattttctatgttctatgataggcagttagaaagacagggtgattctatgcagatcagtattcttttaatggaacagatttttgagctttttctcatgattctgatgggatttattattgtaaaggcgggaattgtcaaggaagaagacagtaaggttttatccaaaatcgtactgtacctgatcattccatgcgtgattataaacgcttttcaggtggactatactaaaaaaaccgtaaatggtcttctgatcgcgcttgctgcatccgtattgcttcaggtggttctcctgcttgtcgttttcgtgatgggaaaactgttttccttaaatgaagtggaaacagcttctatctattactccaactccggcaatctgattgttcctatcgtgacattcgttctgggacagaaatggatactttacggatgtgtcttcatgagcgtgcagcttattttcctctggacacactgcaagaaaatcataagccgtgaatcttcctatgactggaagaaaatcatccttaacatcaatatgatttccattgccattggtgccattttatttttcaccagaatccggctgccggaactcattacaaataccatctccagtgttggaaatatgatcgggccagccagcatgattgtaaccggaatgctttttgccggaatggatttaaaagcaatttttgcaaataaacgtgtatatttcatatcggctctcagaatgcttgtcattcctttgattgcactgtttctcataaaaatcagccatcttgccacactgtctgcagatgctcaaaagatcatgctcattgtatttctcgcagtaatccccccatcagcatccaccgttacacagatgtgccaggtgtacggaaacgatgcacactatgccagcgcaatcaacgtagtgaccacgctgtgtgccattgtgaccatgccttttatggtgctgttgttttcctgtatttaacggtatattttcgcttttttctgcaataccggataaaatcataccataaaaggacaagcacagccccgataacgatcgcttttaccacaagcggcatatgcccgtcaccgaatccaaactccacaataaaaaaaacactcagtgcgatccacagtgcaaaccatacccatccaaacagcttctgatttttgaccttacaaaacagaaactggaaaaccggatcgccactcactttataaaactcgctgtactccgaaaaatcaccgacaagttcctccaattgcgcaaagctacgtccctttttctcttcttcttttacatagttgaggtaaaaatcaatattttcgccatcgtaggcatgatctgctgcaagtttccggcacaggtcgatggaaccctgtatttcctgctgcttatttaacaactcctgcaactgctgccggaccagttcctcagaaactgccggatcatccagcatcaaggcaattttttcgatgggcatattcattttccgatataaaatgatctgttttaaccgccggatatcctgttcactgtaattgcggtatttgctttggtcattccgctccggttcgagcagcccctttctttcataaaagcggatattgctgatggttaatccggtcagttgtgctgcctgtcctattttcatctgtcccgttcctccttctataatatttgaaaatacaattatctctttcccacctcacgccgtgcctggtctgtaatttcttctggaaaatccagcagttccatcaaatctatggcatttgttttcccgacgatcccacgtctgattttgtatggaaaaacgatatctttttcatgaacctgactgtcaaaataataagtgtcgtatcggtttttcagggcatacaccagctccagatcatgtgtggcaatcaggagaaagccctgtttctgtaccatgtaggataaaatggcattggatgccgccagacgctcacgcgtgttcgtcccttttaaaatctcgtcaatcacaaacaacatgggctcacccgttttcagttcatcgagcatgcgctttaaatatttaatttcacgcatgtaataactctctccctgcagcacatcatcccgaagtgccatcgaggtcatcacctgtattgcaggcattttcatattttttgcaacacaggtattgatcgtctgtgccagaatcacattgatggcaaccgctttcataaatgtcgatttaccagatgcatttgccccggtcagtaccacaccttttttcaggacaaaatcattcgggattgcatctgccataagaggatgactgattttctccacactgattgcgccatcactctgcaatgacggacaacaccattgcggcaggcttttccggaaggatgcaatcgcaatctccatatcgatttctcctgcaaatgtatacagttgcatcgtctctttttttaaattctggcagaactataaaccatgaaccagggtgagagtcaagggatttttaccaaaaagaccgtttctgtgccgtataaatgcagcggttgccattgaccagaaatgccaccaggcagactgcaaaaaatgcaagcccattttccacaccaaatacttccattccgatcagaaccggagccagcaaagtattggttgcacttccaaacaccgccgtgtatccaagtgccgcgcagaccatcggtggcagtcctgccaggcttcccagcacaaaaccaagcgatgcaccgatggaaaaaagcggtgtcacctctccgccctgaaacccgatcgacaaagtcagtaccgtaaagagcagcttcaaaatccagtcaaacatatacagttctcccccggaaaatgcctgcgcgatcagattggttccaagtccgcagtaccgtccgttccacgccagaaaaaggaacaccgccagtgggatcgacacaaagccgattctcttgtatggattttccagtacgtttcccataaactgttttactttttgcaaaagcaccgcaaacagccgtcccgtcagaccgaacaagattccaaaaagaatcagatatgtcaccgtctttgtgtccgtcaatgacagggtctgcgaaagaagaaccgaaaatttttccagccccagcacatgtgaagttgcagatgccgtaaaagacgcaattgccgcaggaagcaatgcggaatatgccatacttccactcaccactacttccatcgcaaaaaagactgctgcaaacggagtctgaaagaggcctccaaatccggctgccattcccgcaatcaatactatcctgccgttgtccgggaagtggaatctgcgggcaaacgcatgggaaagtgtggcaccgatctgcacggcaacgccctcgcgccccgcacttccgccaaacagatgtgtgatccatgtaccggccatgacaagcgggatgagtgccagtggaatcgactcccgctttccctgcccggcttccatgacaagcgtcattccttttgacgccgtctcattgaaatgccggtataaccagacgatcccaagccctgccagcggcagaaacggcagcaatacaactacatgcgccgaacgaaaatctgtaataaaaagtaaaacacgaccaaataccgcgtcaatggcaccaattgcaatgccaaggagcagcgcagatagcgcatacaaaaatgtttcttttgcttttttctttaatccctgtaaatcatgtgacggattcatggttttcctcttctttcataatccctttttcgtctcttacatgcgacatatgaacaattgatttactgctacatccatcctgcatcaatccttcccctgcacatcctcaaaatcttacagcaaataaaaaaagccgatggtctctgcgatcaaacaatcgtagaagtcatcagcttatcgttcagcagttcagggaaattcccttgggagaacttcattcccattgacagattactccttttcccataaaaaatcaaggaaaaaaattttggaccacatgttacaatctgctgcttttgtaacttacatcccggatttttcattgctacaataagggtatcatgaatgtatgcaaaggagacgattacaactatggcaaacagaattatgttaaatgaaacatcttatcacggcgcaggtgcaattcaggagattgcaaccgaggcaaaagcacacggattccagaaagcttttgtctgctctgatcctgacctgatcaagtttggtgtaacaaaaaaggtaacagatgtactggacaagaatggtcttgtgtatgagatttattccgatatcaaaccaaatccaaccatccagaatgtccagcacggtgtacaggcattcaaggattccggtgccgactacctcattgcaatcggcggcggctcttccatggatacttccaaagccatcggtatcatcattgccaatccggaatttgaagatgtgcgcagccttgagggtgtagccccaaccaaaaaaccatgcgtaccgatcatcgctgttccgaccaccgctggtactgcggcagaagttaccatcaactacgtcattaccgatgtggaaaagaagcgtaaatttgtatgtgttgacccacacgatatgccaattatcgcaatcgtagatcctgagatgatgtcttccatgccaaagggacttactgcttctaccggtatggatgccctgacacacgccatcgaaggatacactacaaaagcagcctgggaaatgacagatatgttccacctcaaagccattgagctgatctccaaatccctgcgcagtgccgttgcaaacgaaaaagagggacgcgaaggcatggcactcggcgagtatatcgcgggtatgggattttccaatgtcggacttggaatcgcacattccatggcacacacactcggtgctgtctatgacactccgcacggtgttgcctgtgcaatgatgctcccaatcgttatggaatacaatgccgactgcaccggtgaaaaataccgtgagattgcacgcgccatgggtgtcaaaggtgtcgatgaaatgtctgtggacgaataccgcaaggcagcgattgatgccgtacagcagctttccgtcgatgtcggaattccgaccaaactggaagcactgaaggaagaagacttacagttccttgcagaatccgcacatgccgatgcctgcgcacctggaaatccaaaagatgccagtgtggaagatctgaaagctctgttccgtaaactgatgtaatttcttgcaattcaatataaagtagactgtaaaaagtcactgatgaaaaaaacgccagttccggcaaataccggttctggcgttttaaattatagacaaagtggaagcattttacagcttctttctatattaatcccagtttttgaaatacttccctcagccgcacaggcatggattcggtcagcgcatgtgccagctcttctggcgtacatttccgatacccgagcacccactgcaccgtcatataaaccgaaccaagacaatacatttccagttcaaactgcaattcggtggaaatctttcttcctgtccggctttcgatctgctttgtgtaaaactcctgaatcagttcaaaatcatgatctctcaggcaattctgctgatcatttttgaatgccgcccgaaaaaacaactgctccatctgaatgtattcaaatttgttgacaaggctctcgtagacggttcttccttctcccatgtgctcaaatgattccagcaaaatcttatcaaaataccagttgatcagatcatatttatcctgaaaattccgataaaatgtctgacgcgtcaacccacaggtttctacaatttcttttacggttattttttctaccggtgccgtgcgcatacattctttcatggcatttgccagcttatagcgcacaccgtcattctgcttttgtggttccatgtttcccccagtctggcaagtttctcttttggtttattattgtctattatactatatctgcataattttttcatctgttcgttttcttttaaattgctgtttaactgcgtggtctgggacctttggggtttggcaggagggacggatttgtggggaagttggtttgggtataaggtttctcgatgcgacggaagaagggggacattctctttctacagaaaaatttgcaagttagcgccgatattgatttcaggtaagtttgacaaatattttacttttatgccattagcgttatgtgatggaactacggcgcagttgcaaatttgttcttccgaaagaaatgtcccccttcttcctgttggctggagataatataattgagaaacatatttccgcaaatcctgtctgtggaacaaatataagggcaccagaacttgcagttaaaggcgctcccggaaggaaatgcatacaatgagtgtttacagtaaagtgataaatgtttgggaagcttgacttgctaataagtggaaatttcattgccggtattttgtgaaacaatcgttctattgaagcctttatatgatcgggcattataaacttataaataaaggatgggttctatataattaaaattcataggaaaaatgttgccgtggcagatgaaaagcactttaatcatagttttatttctccttcttttgccccggaatgccctgttttgcaagggattccggggttattgtaaaatgctctgaaattacagattgtggcaaatcagagcagaaccctgcaagttgttactacctgttagtagtaaagttggtagtaaaagattatgccttactactaagcattttttcattctcccagacatctcttctaatattgcttccatccgggcactgttctaaacactgacctaaagcttggtaatgatctatataatagcattctctcgaagccataaactgaatatctttataatagttttcataattaaacattatttattcaatcactcgtacttctatttttttatgcttatcatttagtgcctcaatcaccttatcatttcgtaataatcattttccaagtttaacaaaatgtgcatcatcgcctgtcgaaaatcttttatagatatttactgtttttcctacatatgcacaatatttcgtctgctgtttattatcaataataaaaataccatatatccctctattttttgtaccatctataattcctctttcaaaaacaatcttgttatttccaagagtgtatgtccattttaacgtaagatttttattatccatagaattcctctttatttaatactaaaatgaaaattgtactgtgtgcatcccttacgataattttatcgtgagaatcaagcataatttataaatatctcaccattacaacatgtctttctttataaaaaaaatttgtaaagagttaacttccttatcacaatttaacaaatacgttatactgcgacatatttatatttatgataacgcaaaatagagttttctaaacaatcactatccatatgaagttccccaaccttatctttatttattataacttcaattgatgtaattccatcaaaatgttgaccaattgttttagaaggcgacaacattatttcaatatcactatcattctcaaattttatatcttctacccaatatttcttaatatgcatgccatcactgtcaaactctgcataaagtacaatgtcttgtttattctcgcactctcccatagcatgcccatcaactaccattttccctacatggtatctattacaaacaggctctgagttttttaacacaaaatcgacgctctccatcacatcaatatataatccaataaaattttcataatatccaatcaattcacttgtactttttgacttatatatattaccacgatacttaaaatcaggaatccgtatatctctttgtccagaaattacatccgcaaatgatgaacctccatataagtcaagtgtatgttttccataattatatacagaacgtatatagcaaacaatctcattctcccataatttttctacatagctatttatctgtggcattttttctaattttctatgcatacttccttcagtaacggctttctgtttcagtcctaaattaagtgacgcattaatatattgcaacaaacaatctagtgaatttgaaatatgcgatacccactccaatgtcaatttgttcaaaattgtatgagcattgtaattccatcccaatacctctacgctattataaaacggatttttttcaccctcactaatattctttttccctatgtcttcataaagttttgcagtaatgatggcatagtttaagtataattgtgatgaatataaaaactgacgtgcatctaagacacatttttctctcaaaaaattttcatattcttttccttgatagtatttcattttgtctgtatattcttgtttcattaaaatacatccttgtcttaaatttaatataaacattatatcgtcattttcacttcttttccatagtaaaaacgccccagcctaagccggagcgtcatctcttttccatattaaactaccttaaacatcttctgtgacatcggtttctccttcttctgctcaacctctgcctgtgcccttctgaactcttccattcgtttcaattcttcctcagcatcatcaaatccgatatgcgtgtacacattcattgtaacacttatatccgaatgccccatgaggtactgtaacgtctttggattcattcccgattttgccatattcgagcaatacgtgtgtcgacatacatgaggcgtgatatttggcagctgcacccggtagatatcattgtaccttccaaccatatgattgaaacgatgttgccagtgcattgccacaagtggcattccattatcatcgtaaaacaggaatccgctatatccatctatggatttctccactttcggtgcatttctgtcctcgatgattgcctgaaacatctgtgccacatcctctgtaattggcaatactcttgttccggcatccgtctttgtagtttctatgatatatcgcatatccgatgttcgctgcaactggtggtcaatatttacagttctgttctcaagatcaatgtccttcagcgtcaagccacaaaattctgatattcgcattcccgtatgaaataatatgtacaccacttcataatatttacagtacaccacatcgtcatgcacaaactttaagaactttctcatctgatcttttgtgattgcctctcttgtaactgcatcatttaccaatactccggcaagttgaaatccaaatggattctttaccagaatgtcatcatctaccgccatctgaaaggccgggcgcaacactccccggatggtatgaatggaactgtagctttttccatcttcctgttgcaattttataaggaacagctttgcatcggaagtctgagcagaaaacagcggaaagcatatttgtcattgtccgtttcggtcggctttgatgatacccttttttgcatctcttgccatatcacacagacttgagataaattacgtataggctgcgattacatctccatccactgtgtatggaaaccatgtgaagtttattttttcatctgtaatttcaatttctgtgctgtccgtccgaaatgcgcgttgaaaaagcatctgcttatttgctataatcttctgtaaattttccaatgccgtatccgtaaggctctctttcgaaatcgctattgtcaacttatcctgttgcactggcacttcttccgttatttccatatcgtcctgaaacccatgttcccgtaactgccgaatcaggtcttccactatttctttttcagttccatccgggatatgcaataccccctctttatccagtcggtatcctgcaatatcgtatgcacagcttggtacccgttcataatgcggtgctgtcccaagtatgtttccaatctcctgtgccagtttcggtctctgctttgatttcaatgtaaatctaatttcattcttcataatatgtacccgcctttctttattcggtagtacatatatcactctgatggtacagaattgcaagacaattcggattatatttctgccaaaatgtacgcagaaaaactgtgatttttatactattttttacacgttttttctgcgtatttcgttactatccggcaaaacaaaatcggctttagcgatgatattcagcggatattttcacataaaccgaccttggtgggtatccccccctgtttaattctgcgaaaattcgaacgaagggggccatcggtcttcaaaaaaagaaccgcggagattttgatacccctatgcatccaatatttcataattcagacaagcgcaagaatcttgacatttacatagctttattcatttccttaatctctttgaatatcgagcgttcatatgatctatacgattcaattgcctctataacccgtttagatatattcgctctttcatcataaatattctttggaatttttaaattgagaacatcttcttctttaaatcgaggatgctgacttccttcaactgaattttcaaataccaactgtgctggttgagaaagcaaaaacggaactaaatatgctattgattcattatttcttgccctaattacaaaaaactctgttgacgcgccaagaatttctttcctatcttcatcaacataagctacctgcctaagatatggtctaagacgcgatataataacgtctccctttctcaatatttttttattactattaatcgaatcattcacttcagaattaatattcaaatatcctcccattgcatctgaagtattaatctgaataatagatttcccctgtgcttgttttttagttattatgtcattcactatttcaacaatttcagacatcaaaatagtatcttcattatctatactcattcgccttctaggattatacctttcaggtgtcaaaataaaatttacacctagttgtttatttgatttcaaaatacaaatcgccataaaatcaccatcctatcttttctgcattcttaaagtcattaaactcaagcaaaatatcatttaaatcatggtcaacttcagcccatgtgtgaatatctcctttatataatatatttcctctaccatcttttcctggtttctcactaattgcaaaaaatatgttttcttcacatttgctctttttttcacgcttttgtaaaaatagtatacttgtttttactgctgtatgtggcatgaaggtatttcgcggtataccaacaacaccaattattctacatttttcatttatccaccgtcgcaaatcttctgtttctctactaccaaatatattgtccggaagaacaattgacattctaccattaggttttaataattcaatacatctttctataaataaaatatccctttcaattctattttttccagtagaaacaaaataactttcaagaatctccgattctgtaatctctcctgcaaaagggggattcgtcattattatatcgaatagttctttttgtttttctattctaagaatatcctcaatagatgttatattttctccgtctgacactttattattttttatcaaactattaactctataaatatgagatttttctaatttcgatacatacattaacagcttcgcaactctcgttgctactatatcaaaatcaaatccccacaaatcatttgcattaataccatcacagttttgcttcgcatgatataaaaacgcaccagatcctgctgctggatctaggattgtctctccaggttttggattgataactttcgcacaaaaatcaacaatatatctcggcgtaaaatactgtccttttgatccctttttctcctttgaaattaaaaattcaaaaataccatcaacaccttcatatccgtcttttagcaatgaaaatgtttttaatattgatacgcatatttgataatgctcctcacataataaaagtcttggttcagataagacccctccccacaataaatcaatttttcttaattttagatttgctttatccattgtaagttctactggttcgtcattcagttcattccacaatttcagtactactaacttgaaaatttcctcaaattcattctcacctgaatttgctaaaataacttcttctaatcgtttatataagccttcaaaagtatccagttttttgctttttcgtgtagccacaaataatcaccttcctttgaatattaactttatcacatacatcgccttttgtaaagaccgccgtcttctgtatatatctttattctaatttggaatattctgcattggaatattataatatttttaggaggtgtccatatgaaaagtatatatgatgaagattatatagaaatcataactcgtttacggatcattcgaactagcaagaatatcacgcagcttgacttagcaaataaaatgggaaaaacgcaatcatttgtatctaaaatagaaagttgtgagcgtagactagatgttattgaatttttaagatggttagacacattaaatatatccttttcagatgttataccatcaaaatacactaaaggagaataagcttattatgggatttatgcacaaagatgaatatgaagatttcatcattcatcaaaacgcaactgttatttctgcagaagaaatatctgaaatgaaacaaaatctatcaccgcttattggtgctcaattcaatgtactttctattcctaaagaaatactgaaagcatttgagccatctcaaatcggcaccatcgtaggatcacttatggatgcatgtattcctcaattatccatattaactgattcggatatgtttaattctgttggattaaccaaaaatgaaggaattctaggagatagagaaggttaccctgattatattcatacatcgggcaaacgtctcgaactaaaactcttattcgtagataacccaaatattgaaatgaaaaaaccacctacaccaagagagccctctgctaggcttacgcaaaaggtaacattcaaaaatgttattcccgaaaaagatatgttattagttatttcatatgccctaaaagaaagaaccgataatccgaatcttttttcaccaacaataatcaaccttgatatttttcctgtctatgactgcattttagcccgtgatcgaagaatgtataatagccacggtggctggtttggttattttgaaacacctaccatattaagtaatcaggggaaacaaaagatggccgctaatattgaaattgattattcatcttatggtcggaaagaaaatgaaggaaaagatttaaacgaagatacaaatttcggcaagttaaaaagaataccttatccacctcttcaatattacctaaaaatgtcaagttcttcttttgataacagcaaagattgatactatcaagccacaatccttgtagtccacctaccaaggattgtgacttttatcattcatattcaccctctaagtagtcccttactactaaggatttctccccacacctttgcctttatcccgattccgtccatgtgccttagtagtcgaaaccgtagtaattccaaggctttccgccatattctgccctgtattgccccagtctgcgaaggtatgcattatcataaaactggagtgccgtggcagatgaaaagtacttttatcatagttttgtttctccttgttttgccccggaatgccctgtttttcgagggtttccgggtttcgtgtagtttgctctgaaattacagattgtgtcaaatcagggcagaaccatgcaagttgttactacctgttagtagtaaaatggaaagggttactactaaggattttattcgtcatccttacagcacctctgtgtataccaataattcaattttcgatgtctatcatatagttttccaactgctcccgtattatgtaatcctagctctattaacagatgatactcaaatatgtgcattaataccattatcgcatattccatatctatccccttaaaagctttttcttcctttgcttttccataatgtgtgtagtaatgtctagtatctacaactttttcaataaaatcgtataattcaattattttaccattggtataaactggggttatcggagtcctaaaatcatcattcatcaaatctactaatctacttttcaatattatatatgtaatattttcgtctgactgcgtaacatcaaaatatgcatttctttgtttttcatcaatttcatctatggtcttacatctaaacaattgtaaaacatgtttcttatactttttcaaatcattatatttaaatcttgcatgataagtttccaatgcctgcactatattcaaatatttcatctcaattggcatatcatcatatttaacaattgaaaagtaaagattaatcttccccatatacatatagaaatgctttaccggccaaactctggctatatattgcagctgaatctataatgtcctgtctaattgcatttttcttatctgcttttgtcgccatttacccctcatatgtaaagaggagtgtgatacttaaccacactcctctaaaaatttcttttgaaaaagagttttctgctggttgtcagcctcggtacccaattaagatacccataacgacgtggaaatcattaagtcccccacgtggactacagctttatccaagctgccaagctcgatgcccagttaagacatctaatgagatggaaagttatcctgctccatctgcagcccaacttttaacgatgctcttacatcgagaacatttctgttcctacttttagtatactcaattcagtgaaaaaatcaacctctactgggtatttctaattatttccaaatgtccccttttcaaaatctataaaataaactccttgttttagggatctctttcttgatttttgatagattttgattggattaggaaacaaaaaagtctcatctggttgcgcatgaaagtcagaggcgtggtgagctctgttattactaatatataacctctgttactgctgtcaagaggctttttttatcgaggacagtcaattaacaaaattttgcctttctaggaacccgtataaaataggggtacaaatcactttccacttcccacaaatccttgattttaaggcatttcaggtaaaagtacagtttctgccgtggtatctatcccaataaatttcatgtaaaagataccattgcggtacctacacgctgaaaatttaacattcagataccggaaagtctctatagatcaaaaattgcctttccagataccactttttctaaaaaaacggtatctggaaaggcaatttttactatataggtgacatttcctgatttcaagcattaaaatttcgaaaaaccgtcacctaaaactttaatttttcatctatagatacccggccgtatcatcaagtgatttaacagggtatttttatgcttattccagttcatgggattcgtagctccttttgaggcgtccccttaactgcaagttctggtgcctttatgtttgttccacagacaggatttgcgggcatcattctttttcttatagttttccaatccacaggaagaagggggacatttctttcggaagaacaaatttgcaacttgctctagcactcacaacccatagtgaattgcgtaaactgaaaaactctactccacgtacctgaaaccaacgccagagctaacttgtaaatttttctggagaaagagaatgtcccccttcttccgtcatatcgagaaaccttatacccaaaccaactcccccacaaaatccgtccctctgaaaaacaaaaggctccagaccccgctgttaaacagcaatttaaatgatcaatgcaaaatatccccaatcccatataagttccgcaaaactattctccagatactcgcggatatcctcatcctcatacccggtcatacgagaaatcaccaccatatactcccgcaccatctcataatcgagtgcctcctctgccggtatcccatctgcatccagacaccatttcaaaaacagactctgccggattgccgtatacgtaatcgcaatccactgcatctgcagcaccatgtgctccagattatctgcctcttccggttccgtctcaaaattctctggcaaaatcagatccgaaaacacttcgtttctgaggaaattacgaagcaacagttcatacgatgcaaatgcattccggaactgtctccaccgatcccaaagctgtcctgcctcattttcccccttagtggcatccatatcttctcccacatggattccctgccttccgaaaatttgggaataatattctgcctgtgtaatcactggtgtcaaaaacttctcatacaatccctctttccggtaattgaccgccagatcctgcagaagctcattgcattcttcccaggtttccagcgaagagattgtgctctttgcctgtgtgattgcggtgcgcagttgcagcagtgtttctggagaaaaatattcttccaccagttccggtgtgatgggctgatttttatacaactccagcagaatataaaaactttccagcagagcctcctcgatagaaaccgtatggtcccccagtaacgccagaatatgttcccggatcagaaacatcatttttttttcgtctttttccacacacatggtatgtcccgacacatttgtccacgtgttttcacttgaaatgtctgcattgctgtgcacgaccgatggaaacgtaatctctttatgccgccacagatcaatcaccgccggacaccccggcatcaatgtatcttcttcatgatctgcaaaccggtgcacttcccgtggaaatgtcgtgcaggtttccgagagaatcgaatccccatacgccaaaaccagacggcacagtttgtctttggcaagaaatgggcatcgatgctcctcgtccagccggataacccggattccatctttcatacaagtataagtgccgagatttttcccacaattttttgaatctccagatacctgatccaacgactggcttttagcgcatcccagcatcgtatccggcggaaggactttcttccatctgcggttcgtatccgcatccaccgcaatcttccactcctgacagcaggtaatcggacactggccggcaatgcagctgaattcatcataataatccggacggattttctttcgttctgttttcatatatcctcatttctacatatgcttgttcagtactctccatgcaattgcatagacaataagaaacagacagatcatacacgacatcagcttactgatcatcggatcatacagtcctccaaaaagaaaggcaaaatacattacaatcagaagcacaaacgctgccatccttaacgcacgcgacccaatctcaatatttctctcgtccgttacctgcagtcttgcttcctttaatttctcttcgtctttcatcagacgcttattgcggatcaaaaaaacaattccagaacatataagccccacaccgatcccacaatatacacccagcatataatcgtctactctcatctttcctgaaaattccatataataagcggctgccgcactgattatgccaagcagaatcaatcccagcaggcatttatttttcgcctgcagctgcttgcggaattcctcattgtttgtcactttacttcctgaaaataaacaaaatcccttcatatgttttcatcctcctgatcaaatataaataattcttcaatggttacgtgaaaaaactgtgcaagtttatgtgccaacactaaagaggctttgtatctgcctccctccagggatataatcgtctgtctggtcacatccacagcatctgcaagctcgctctgggtcactcccagctccttgcgcagatcctgaattcttgttttcatgcttcccctcctcacggaaatttttatcaagtttgctttacaccgcgaagtatagcgcactttacattgtatgtcaagtgtattttacattttcatttcagaatttcatttcagaacgaagcaaaactttgaaagtttctattgaacagtaacagacaattggtataaactgtgtatatatcgaaaataaaggagaacttatgaaattagaaaattacgaagtgcatctgccaagctattccatcggcgatcacatctacgataaaatcggtccggtctgtgaatcctacggaaacaccgtgcttctgatcggtggcagacgcgcacttaaagcagcggaagaaaagatccgcacttatgtagcaaaaacaaacttagaaatcatcggtgtcgaactgtacggcagtgactgtacctacgaaaccgtggaaaaactgcggcagcttcccgtctatcacaaagccgatatggtctttggtgtgggcggtggaaaagcactagacaccgcaaaatgtctgtgtatcactgacgataagccggtctttacgttcccgaccatcgcctccaactgtgcagcatgtacttcggtatccatcatgtacaacgaggacggcacattcttaaaaccaaacttttttgtacggcctgccatgcacgcatttatcgacacggaaatcattgccaaagctcctgcacagtatatgtgggcgggcattggcgatacctatgccaaatactatgaggcaaccatctcttcccgtggggaacagctggaacatttcacctcccttggtgtggcattaagtgtcatgtgccgcaatccgcttctggaatacggtgccaaagcactcgaggatcataaaaaaggattatgtacctacgatgtggagcaggttgtccttgccatcgtcgtgacaaccggaattgcctccattttcctgacgaaagatttcaccccggattataacagcgggctggcgcatgcaattttttatgcgctgaccagttatccgatcattgaagaaaaacatctgcacggagaagtcgtgggattcggtgttctgtttgcactgcttgtcgaccagcagtacgaggaatttgaaaaaatttataccttaaaccaacagctgcagcttccgacctccctggaacagattgagattacggaagaacagtgggaggaaagtatggaccacatcccggaaatgtccgatatcagacattacccatataaagtaacaaaagaaatgctggtccttgcaatgaatcagctgaaagaacgggagggaggcagactgataaatgaataaaaaatcttctgccggcaccggcacctattccatcatttttggtgttgcctttgtctggttcaccacgcatttcggcggcggatttgcctccggcgcccagatttacagttactatgtacggttcggcatctggtgtctgatcatgcctgcacttgccatgctctataacggtatcttttttgcctacggcatgcgctttgccaggaaacacgaagtgtacgattaccgctcgtacaacaatgcattttacggaaaattcgcccctgttttttccaacctgtttgaagtgctctatatctgcgtcatgtgtgtcgctcccgctgttgcctttgcaaccggcggtgcaacattaagtacactgacaggacttccgtatctgctgtgtaccctgatcatcggcattttcatctttatcgttgccattttcggcaccgacctggtgcgccgggtagcctccgtgctttccatctgcatcattgccgggcttctgattgtatacattccgaatatcatccacggatggtctgccatccgcgcaaccgcacagcagatgacaacatccacacaaccattcgggaaggcactttactccgcattcctttacggaacgttccagttggcaaacattgcggtatttgtccagcataccaaagtattcaaaaaaccgggcgatgcagtcaaaagcatggggcttggctttctcatcaacgcgctgatgatgacgatggtctgtcttggaattatgaccgtttccacaagcccggatatggcaggtaccagcgtaccgacactgcttatggtgcaaaacggtattggaaaaggatttatgacaccgttaatttccattctgattatcctcggtgccgtatccaccgccgtaaatatggttgccgccatggtgaaacgtgtatccgacggacttaaaaaacggaccctgtccggcaaaaatgatgtatctgccgggacaccaaaagcagaaactccggacataaacaccagaaaacgcatctcctcccgtgagattatcattgcactgatctgctgtctgattgattttggcatcgcacagttcggcttactgacattgatccagaaagcttacagttttctggcttaccttgccattccggtgatccttgttccatatatcattcacatgattgtgacacgaatggattccaaataaagcaaatgtaggaaaaaggtcttattgacgaaaaacatctttagatgatacgatacctccatatcaataaaaaatatggaggttttattttatgaaaaagttaaagaaacaatttctggcagctgtgcttaccgcagttatggcagtatgcgcttttgccggcactactcctgtagcggcagcaaccctttctgccaagcagtacatcaacaaaatggcgaaagccacagaaaaattgaaatcctatgagatgaaaatgaacatggatatggacatgtcggttcagggaaaaaccacatccaccaaaaccacgtcaacaacgattgcttttgccagtccgctgaaaaccaaaaccgttatgacgatgacaatcccttccaacggtaaggacacaaaaataaaagtaatctcctacacaaaacaaaaaggcaacaaactgttgcagtacacctctacggataacaaaacctatgaaaaatcaacactggatttgtctgactactccgatatgctcagttctgtacagaccacagatatgtattcggatttaaaaattgtcaaaaacagcgtaaccgtcaacggaaaatcaaccgtacagattcaggcacggctgaagggcgaagatattgccggtcttcttgcacaacttggacttaacggagataacacacagggaacatcttctgattacagttctctttctccgattaccatctctctctggattgataagaagacctattatccggtaaaacagacgatcgacatgaaagacttcatgaacgagtatcttagttctcttgtagcggattccgatatgtcctactccaagattaagacatctgttacatacaaaaacttcaacaaggcaactaaattttcacttccgaaagcctgcaaataaatgaaagaaatgaaaaagctggaataacgaccgattcgttattccaacttttttattttccctgtgtacaattcgctgcatcaatggcaatgacaagcatcaatgccggaatctcatcttcggaatttaaaatattaatcgtataggtatctccccagtggaacagttcctttgaaatatgcacgactgaactgcagcccgcatacacatcatagtcccaggagagaaaatctccctcacaacgccatccgttataatcaatttcataacgcggtttaaaaaacgtaaattccttttgaatatttccaaattcacgtccaccgattataatatcaaacgaaggaagaagcgtaaaaagacgctgcttgatcataccaatttcatttccggaaacatcaaatacatggatctggtgccccagccgaaacaattctgcttttacaaaatactttttatttcccgcctcatcatagacatcataggtatccgtccatgaaaaaacacgctgtttcatcagtaatttcatattctttttccctctttcttcttttttccgatctgtggcaacgtaatatttaccccaagtaccagtttcacaagccagacaaaaaacaacagaacaagaatcggtattacacaggaagtcacaagcattaccgcaatcgcttctataaaccggttcagtgtattttccagatttacttttgctccggtcacggtattctcaactttgtccactagtcccgaccagaaactacttttcccaccgtcatcggaactgctgctcccctgactctgtgtatccgcctctcctttgatctcatccgttgcctgttttgctgatgcaatggtattttccatggaagctccatatgtcgcatcaatcagatccgcaaccctgacacttaccggaactaccagataaacagccagcccaaacaaaaccagcttacaggcaatggttctgcccagatcttttttgaatccaaaacaaagcgacaacaaaatacatccaatcggaatcaacagtttaaatgctgccagccccgtaatggtaaccagatatttttcaagatagattgcacagacaacaatcagaaaatacgaactcagatcggccagtttatccgcaatcggagtaccggcatctcccggaataagcgtaattgcggcagaagcagctgttgccgctgccgtcagttccaatgcagttgtctttttgtcatccagtgactgaatcgcgtgtgcatttatcttcatagttggagatgaggtgtattttgcaatcacacaaaatgacagaagtgcacacaaaaggggaatcaaaatcgatacgatccaccggattctctccctctgttctgcctgtttgtggtttcctgactcgtccattgttcttcctctctttctggtctacgatcccgaaggaagccgcacgatgcgggtctttccttccttctttgcgcgcatcagtaccggcatgtgttttttgcggagtgcatgcaccaccggataagctgcaaacagatctgccgtaacataaaccgcttccggtttacattcgagtatttgttttacaaactctttcatatactttttccagtcttctttttccatcgcaacttccgcatacatgccctgttcttccagatccggaagatgcggaagtgtcatgtgacagatctgtgcatcggtcatatccggaatctgcctgagcatatgctctgtttcttctctctcgcaattttttgtctcctgtgcctctccggcatcccacagacacacgatcaccggcttttgctcatattcttccagactgatctcacatgccctgatggcatccgcctcgtctccaaccgtcataagaaatccgcccttgtggcagaaccctgcgctggcaagccctgtagcctcctgcagttcttcattttcaagccccagccattgctttggaaaactgcatttgtaattcatggaatccggtttcttctgtggctggatacaatatccgccacgattcgacggaaaaataacaaacgcgatatctgtctccttcagccgtttctgacacggaacaaattcggaaaggacaagaatccttgtatctgtcagatcttcccgtgcacttaatacttcctcgatctgtgcatctgcccgtgcatccgcacgataacgcgcaaatttattttccagaatcattcctgccatctgtaccgcccgctgaaattctttggtcagaccacgggatttttcttccgcagtcagcgcaggctcagcagatatgctttcttcttccttctgtatgtttttttgtgcgtcccacaccggattaaagtttccgatcagtgtcgcaagttcattcttttctccggtattatcattgttatccaacggctgcacaaattcttcatcaaaccgctgcgctaacgtttcccctaagattccgcttccgagttcttcccagagcagaccaaaggcggcatacggtactccattttcacgcacacggctgtctctctggtgatgatcataccgccctctgccaatatcaaatacaatcccatcatattcttctggcacacggtttcctcttgtgattgtaatctgcggattcagatacaacaataatgcggatgaaaatacatcatccgcatgaaattttccgctatgtgtaaatgcttttgcattcggttttttgatctgttctaataatcccatcttgtctttctactcttttttattttctgtaattccccactctttttccatataatctctgcccatgcctccaccgacatccccgctcacattgcggagtgcagccatacatacgcctccaagcgcaccaactacaagaatccccagtaacatccacataaaaattccccctctccgaaaatgatatgttttcttcaatatattacacctgtgtgatgaagtcaactcatttcacaaaaagggggaaaatgtgtacctgaacagcatggtgttcaggtgctgagtgaacagtaacaaattatgaatcgattcacacttttccttgcagagattcaaaagatatgttattctatgtatagaaaaagggaaagctagagaagcggcttaccccaataattaaaaatctgttttaacaacagccgtcattattgcgagtaatggcggctattttcgttttcccttgaaaatcgtgtaacacaatccaacaagggcgcaaatgaatatccctatctgaatcaaatcagaatatgtaacatacattggcaacgccctcctttctttcgtctggagggttagcccctccgaaaaagagggtaagccgcccggctctctagtttcccatgtatctatactatcattttagaaaaagtctttcaatcaaattctaacctgattgtctttttattcgttattgttactctctgattacatagaaatccgctggaaaggagggctaagccatgagtattgtcgactttatagcagtggtaagtttcggcctaacctgctttggtcgtggatatacctttggcaaagataacaataagccacaaaaatagccgccatattacaactctatttcctccacctgaatcttctggtttaccatcccctggcggctgaccagcagatacacctttaaatccagctgatcttttgcaattgtaaatggctcctgccgcacaatttctacatatgcgcccgtcttttccagttcttccttccgtgcgtttgcttttttcagacacagtgccagccgttcctctccgctttttccgaacaggcgtcgcggatagatggccgtctcctttttgatcgtttccgtaagtgttttcacaaagccaaaatgaatgctatggtgcaggacgtgtgccacccacctggttacaattgttgacggatgtctgcgataaaagcgaatccagccaaccagcagccagtctttcgcctgcttcgccaactgctccatcacatccaggccctgcaggaaagaccctttcggcatctcatgtggcaccatatacggctccggtgcagcacagtaagagcagaaattaagcgccgggacatccgccagatggaccaggcgcttttccccctcactgcagtaattttcccccaaataggtatacttgtcccacagcactgcaatccgaaattccagctgacgcagattttcataccgcggaacccagaaatgtgcaatctctccgtagttatatagatttacttccagctccagcttctgataaaacagggtaataacactgtctccctgccgcaccccaagcacataccggttctgatcccggtcataagaggcatccagttttccttcataatcctttttgtatgtgcctgtgaagattgcttcccgaaaaacaagaaaactctccacggtatcattcatttgataaaccaaccggatatcctgctctgttgtatttgctgtatggtcctccggcaataaaagttcaaattcattttgcgcaagcagttcctgcagcatttcaaatgttgtcacgtttttctactccctgatccattgctaaacctatgatactctaatggcttctttcctgtcaatcatcccatattttttcaacaaaaaaacatctgctttctattttttaaaagaaaacagatgtcttttcatccttatctcctatcgatcgcccgcacggaatttccgtcatttagcttcaccggaaaacgatacgaataatttctttcctgccagttctcatcctccatcatccgcaaaagatttttggcggtaatccgtcccagctgatacttcggatgcactgctgacaataatttcactttctgttcctgctgcagctccgcatcatcaaaagatactacggaaacatcctccggaacggaaagtccacggtctgccagaaactccatataataaccggcaacctcgtcattatacacaatcattgccgtacagtcttttgttctgcgatacatatgaagcattccctttttcccaagtttttcatccatatctttggtcgaataccagcggacacaatcgtcatcaaactttaccccgtaatcggagaggcactggataaaacccttataacgctcgatcccctgcatatcatcatatttgaatataccgccaatccggcggtgtccgtgctcaatcagtatttttgtcagctcatatgcagctctggcatcctccatctccacactgtcaaataattggttttcataatgattatgaataaaaagtgttggtatattttgttttcgtatttcccggtacaaacggatattcgggtttggaaatgccgaccgggaaccttcgataatcaatccggaaacattgcttttcaacagtccctccagatagatcgcctcatcattcagtctgttttttgttaccgcgacttcaattccataccctttttctttcagtgccgattcaattccatcgtacacctgtgaaaataaataatccgaataataactaaggagcagaccaacccgttgacgcgattcgttctcggtactgccttcataagacacgtacgttccgcttccgcgtacccgggtgatcagcccctcatcctctaactgttggagagctgtgcgcaccgtctgcctggaataaccgaatttcttctgcagaatggtctcagacggaaacttatccatatttttaattacgccactggtgattaacgtatgtgcccaatgatataatttctgatatttcaaattatcctgttctgtattacgcatagcctctccatttgcctttttatgtttttacttgataacctgaatagactcacgatctgcaaatactgcaacgaagatcaggaatacaataccctggatcagctgcatcatctgtgtagagaatcccatcatggttaatccactgtttaatacgatgtaaagtaatgatccgacaataatattctcgaaacgaacctttgcaccaccggaaattggcattccaccaagtaccagtgcgatcaggatctgtgtctctaactgattaccaccggaagatgtaacagatccgactttgataacattgataaatgctgcaaatcctgtgatggcacctgccagtacatagatcaggaatttcattttgtcggtgcggataccggagaacattgctgctttttctcctgcaccgattgcctttaaataagttccgaattttgtaaaacggaatgccacaaatccaatagcaagtatcacaaccgtgcaggcaactttcagtgctgtgctgtcataattgatcagctttgcagatccggctaccggagcgttggttgtcaggtacttgataaaaccacggaataagaacatggtacaaattgttacaatgaaggatttgatcttacggtttacatagaagtaaccgttgatcgcaccgattgccgctcctgctgcaataccacctataattgccagcggaatgctgtattttgagagcatacataccacaatggaagaaattccgaggatagatccctgagagaaatccagaccacccattgtcataatgaaaaatacgcccatcgcagaaatcatcgtcacatatacctgtgagagtaccagtgacatattacccatcattcgaaaatctgtcaggaaattgaataacaggaaaataaccaccagtcctacaatcggaagaagtgaacggatcagcgacatttttgatgcttttttgagctgctgctctttatcgtttgtatttacacttgcttgacttcccatagctgcctccttataccatcatcgtaatcagaccattttcatcaaggttctggtcacgctcaagttctccgctgatcttgccgtctttcatgatcatgatgcggtcacacataccgatcagctccatcaattcctcggagatcatgataatggattttccattttttctcatctgattcatcaactggtaaatatcctgctttaccttgatatcaatgcctcgtgtcgggctgtcgagtacaacgatatcggaatcttttccgatccatcttgccagaacgactttctgcttatttccaccggacaggttggaaacgaactggttgacatcgaccatcttaacggacatctgctttgcaaatttgtttgcaaaatcctttttcttcttatcgctgatcagatgtgccggtccggacagttcatccagtgacggcagacaaatgttatctccgatactctggtttaacacaaccgactcattatcacgatccttcgatgtatatgcaatactgtgcttgattgcggtcggaatatcgttgatctgggttccatctgccagctctacggttccttccctgtcataggatgcaccaaagattgctttaccgatctcatgcataccagactcagaaagtcctccaaatccaagaatctcgcctttgtgcagatcaaagctgacatcctcgatcaatccaggtacggtaacgtgctttgcagaaagaaccacttcatccgaaatcttctctccatagtcgctgcggtaataatcgcccgttacttcacgtccaaccatgagtttctttaaatcgttttcattgacatctttactctttacggtatcaatgtatacaccatcacgaagaatggtgattgtatcggatttctcaatgatctccggaagatcgtgggaaataaagatgacggtgttgccgctctttcggatacgctccatatgtttgtacagttcttcacggccctcctgggaaagcgctgtcgttgtctcatcaataacaacgatctttggattaaagtaggttgcctttacgatttctacgagcttacgatcctcgaagttgtaagagtcgatcatatcggcggccttgattctttcaaatccatactgctttaacagctctgttgcctttttgttcatggcatttgtatttttgatgccacagtgtacgaactgatcctcatgtccgaggaaaatattctctgcaacggtcagtccggacaatgtaccaagctcctgtacaatgatggagattccttcattgtttgcttctacctgattctttggatgaacttccttgccatccagaataaatgtaccgctgccaatgctgtaaataccggtaagcatattggtcagggtggattttccggagccgttttctccgatcagtgcatgaacttctcccttgttaacgttaaaggaaacgttctgtacggcttttgtaataccgaagttcttgcagagattttttacttgtaatcttacttcactcattgctgtcttccccctttcattacttgacgatctcgccctttgtagcctttgttgtcagagtaatgataataagcagtgcaagtcctgtgatcacatcctggatagcggttggtgctccaagagcaatgaaaccgaagaagatgatgttgatgacaaactcaccgatgataattgccggaagtggcattccgtatttcttaaatgccagaccaaagaaacatcccatggtcggtacgaagtttcggctcatagatgccattccggtaacggctaccatggaagatccgtaactgatggtcaggatcgccataacaccgaggaatgcaccacttaaaataaatgcaagaactttatacttatttacgttaatacccatgttcttggcaacaaactcatcactgccgatagcataggtgtatgttccaatttttgtgtaatttaagaatatgtaagcaacgacacatgccacaagtgcaaggatgatatcccaaggcatctggccaaatgcacgtaaattggatggaagtgtctgctctacgccgcctgcaatgtagtttgccagagactcatagatcagtgcaagtcctgttgttacaatcatggacgggatacggagttttacataaaacataccgtttaatgcaccgacaattgttcctgttaagatacatccgacgatcaatccgaaatatccgagattaaaacgggtggcgaatacgcacccaacgattgcggaaagcatgatatttgcgccaatggaaaagtcgaacattcccattaccattacaaagtagaatcctacggcaccaacagttgcaatcaggctggcctgaaaatagttaagcatattgccgaaagatccaaagttatgcggcgaaagtattttaaagatggcccaggaaagcacaaccagaccgagcaggatcagataccccattgcttttcccgaaatttttttcgtagtactcatattatctacctctttttgtcaattctgataaacgtcacattgatggaaaaaggtggcgccgcaagcagcgccaccccttgtggttattgttttatttacccgcacgtgctgctgcatcttcaatagatacgctctgtgcagtaattcttaagtcttccagactcagcttagacatatcaaccagttcctgatcggtatatggaagctgatctacgaaatacttctcataattcttgtaatcatctgcagatgatacatacagatatgggaatggaacatcttcgaacttaccaccaaagtctttgtagttaccctttactgcattgtataccatcatgaatgcgatcaatggatcacagaaatgtcctccggactcaccagccatggaaccattctcaagtctgtctccaaggtctggaaggaagtctgtagaaacgacgtcgatatctgcggtctttccggcacgctcaactgctgcgattgcaccctggagaggatctccaccaccacctgctggaataagtgcatccaggtttggatctgctgccatcagagcttctgctgccttagaaccaccttcggaagttgttcctgcgtactgtggctcagaaagctttgcctgatcatctggatgttcttcgttccacttatctacgccagctttatagccttcccatctgccgagccatgtagcatctccctgctcccagccgatcagaccaatgtttctgtcacctttgtttaaaagaatgtttacaagttcttcaccgtttgccggctcatcctcgtgaacagctccgatataataatcagaatcttttgctgcctgataaatatctgcactgttttcctgactgataacacggaagaactgtgccagatatactttattgtcattacaggtcttaattgcggaagtcatctctgtatcagatgagttacagatgataattccctgacatcctgctgctgccaactgctcaacagaagcggtaactttctcagatacatgtccctgatccacatactgtacatcgacatccaatgcctttgctgcctcatccagaatcttcttgcactgagaaccaagtacatcggtggatgaccagatggaaacaccaatcttaatctttccggatttgtttgatgatgtacctccctgtgtggaagatcctcccccgccggttccacaggctgtcataccaattaccattgatgctgccaggatcgttgcagctaccttctttaaaattttcttcatacgttgtcctccttctactttgatacgtatttgtttttgtaattctgattatagactgcctccttctctttttcaataaaatacaacaatgttttttgtaaagttgtattgttgtattgtattttaactgttaaatcatctgttttttacataaaaatgtgcattttgccgagtttttattttattttctctttgttttactattgttttgtgcgttttgcgcattttagtttcaatttctccttttttggcaatacaacttgtatttgagccgcacttgtattttttaaacattcttatcataagaattaaatacaacctgtattttccctgtacctgcctgacattgcacttttacatcatagatgttatgataaaattacttaaaacaatactacagatacaatgaagggagaaagactatgaaagtaatgaatattgaaaatccacaggaatttttaaaagtaattgacagctgttccggacaggtggaactggttacagctgacggcgaccgcctgaacctgaaatccaaattatgccagctggtatccttatctaccatttttgaatctgcttccaccatcccggagatggaaatcatcgcacatgaagcagaggattccagaaagattatggattacctgatgcgcggataaaacgttagaacaataccaataaaaaggagtatgaaaaacaccgttgttttccatactcctttttcttattatatatgtcttatatctttgacctgcttcagacaaaaatccgattagatatttaacagatcactgaatactttcagtgctccgtctgtctcatgtgcaagaacgcgctttgcaagaactttaccaagctgaacaccttcctgatcgaagctgttgacattccataagaatccctggaacatgatcttgttctcaaagtgtgcaagcaatgcaccgagtgtcttcggattaacctgctctccgataataatagaagatgggcgtccaccctcgaaattcttgttgcggttttcatcttccttgccgcatgcaaaagcaacgatctgtgctgctacgtttgcgcaaagcttctgctggcttgtgctgtcctgaatgacaacatctgtgtcaagctggttattcttaaatccaacaaactgcagtggtacaatatcggttccctgatgcagtaactgatagaaggaatgctgtccgtttgttccaggctcaccgaaaatgacaggacctgtcgggtaatttacaggctctccaaaacggtttacggatttaccattggactccatatctacctgctgtaaatgtgccgggaaacgattgagtgcctgtgaatatggaagcacagcagtgctcggatatcccagtacgttacgctcatacacaccgatcagtgcatccagcatctcagggttcttcaatacgtctttttctgcggagagtttatcctctgctgcggcgccatccaggaactgtgcaaatacatccggtccgaatgccagggataatacagctccaccaacggctgatgtagaagaataacgtcctccgatgtaatcatccataaagaatgctgccagataatcatcactctttgccagcggagaagtctcactggtaactgcgatcatatgcttagaagcatccaggcctgctttctttaacgcgtccttaacgaaagactcattggtcagtgtctcaagtgtagtacctgatttggaaacaagtacgaaaatagaatgggcaacatctacagaattcaatacagcggctgcatcatccggatctacattactgatgaattttgcttccatcttgaatgtgttgtttttctttgcccaattctcaagtgctaaatacatagcgcggggacccaggtcacttccaccgataccgatctggacaactgttgtgaatttttcaccagcagcgtttgtaatctcaccagcgtgtaccttattggcaaaatcagcaattctctgctgctgctccacatagaatttacgcttatccacaccatctgctacaacggcttttccaagctgtccacgggtcagctgatgaagaaccagacggttctctccggtgttaatcactgcaccgttgtaaagctcctcaaatttttcggaaagctgtgcttcttctgcaagcttaaccaaagcttccagtacatcatcatccacctgctttgcagcatagttgtacaccaatccctctgccattggaatactgtaatttttcacacgctctgccccgttctcgccagacattacttttttcagatctatgcgacctgtttttgaaaggttctgaaaagaagcaagggtatccaagttgtcccaagtaaccataatagattcctcctatatgttctttgttattttattcctcaaccttactgattatacaatgtaatttccatgaattcaagtatggatagtatgtgaaaaatgcgcttttctttttcttatactgtgatataattcttatagatgttttggaacggcatatgtttattgggggattacatatgattcataaaaaaataggggcgtttatatttcaggatgtacaaaatccaaatgagacaaaaaccactgctgtgaccctgcgtctgtatgcactgattctcagcgtttattttcttgtccttttttgtgtctgctgctttcttcgggatgttccttcctccctgctgacactcatctgtagcattttatatgtatttgctttccggattacctatctgaaccacacacattttgcttccattttttcacaattgctgacgttattgtggattactgtatttatacagagattcgggtgggactgcggtgtacagcacttcctgtttgtacttcttgtattaaattttgctgtcagtttccaccgcatacgcactaaaatctttgttggaatctgcacatgtgcttaccgcctgcttttgtattcctatacacggtatcatctgccggtcatccagcttcccacagatgccagtatctgcatacagaccatagacactttgtttatttttgcagaactgatcaccgttatgattattttcacccagaattcccagcagatggaacacaagcttatacgttacaatctggaactggaacatatcgcatccacggatcccctgaccgggcttttcaaccgttggcagatgtataagcgtctggaaacatgtatttccagatacactcagcacaaattacagaccctgactgttgccatgggggatatcgactttttcaaacatgtaaatgatacttacgggcatgatgccggggatgaagttctccgcacactttccaggttgttttgcacggtaataagcgaaaaaggagaagtctgccgctggggcggagaagaattcctgtttgtatttcccggcatggatatggaggaggttcagcttttgatgtctgaccttctggatgatatccggcacactcctgtattatacgaacgggaactgattcatgtaaccatgacattcggagtcgaagaatttggcagaaatcataccatggaatctgtcatccaggaagccgaccgcaagctttatctcggcaaagagagtgggcggaaccgggtgatctactgattttatgccatctcacccacccggtggatttccgttctttttctgaggaaatccaaaaatctgtcacatacgacggtatatacagatcccatcacattgaatataattcgcagcgccactgccgtacctgcaccgaataaccccgatgcgatcgacagtgcgccaaacgtattaaatacggtctgccatgcatatcctgcagaataacccacaccaattccaccgatcatcccgatatacggatacatggattctggtaacacatgatacaaaacaagaaagatcatgcaccccacaatattaaacggtcccctgcgttttgcacgctccacgctgtcctcatgaaatggaagacatacagacatgcaggcgattcccgcccacatggcacgcggccatccgagcagtgacacgatcagcagtgccgaagaaacaatcagtgtcagcttaatataccaccagttccgcgcggaacgtacatcaaattcccggaacagatccaggaatgtccggcggtatgggcggtttttctgattcttataaaatacagccatgcagattcccataccaatcagcagactgatcacacgcagcacataggcatgtccactcacatcatacccctgcaaaagcagatatccaaggacaaacgtagactggtttgacatgatcacattgtggcatccgaaaatcatgagaatcagaatacatgccacattcacaaaaaatgccggaaccggatgcatcatattggtaattctcggtcctgcgattaaaattccaaaaattcccgcaatacagagcagcccatgactggtacgcaccccgaaatctgcctgccggagcacaagtactgccagcagcacaaccactcccggtacgctgttatctgcaccgaatattttactgaacagtgtaaccacagcgacgcagaataccataacaagatagactttaaaattatagatcaggatatgtttgcgtttttcttttttgtctgttgtgtttttgatcagctgttttgagccaactgaactcagttgtagttcctggtaaaaagtcatcgtctgattccccctcgtttttttaataaaaaagtacgctggctttgtggtgcaacgatatcacaaagcgtagcgtactatacctcgatttttaaaaaacgtcaaggatacgtcctgttttttttagattttgtttagaattattttagatttttcccatctgaaaaagcatttcccactttttcgcccagcacataatactcattgttgaacggatcaaatgtgatcggctgtacttttgccacatctacttttccgtcggtcattgcagcttcatccacactgacattgacaatctccgctaccagtctgcagctttccggatcataactttttactttgcactctgcacagactgccagttcattgatgatcggagcgtctacatttgcactctttgtcacggtaaaacctgctttgtccagttttcctgccacattgtttgcagattcgattcccacataatcacaggctgccacatgctttgcatctgccatgcttacggtaaatgccccggttctctggaaattctttgttgtcttatgtccggcactgatgcagaaagaaatctcgtttccttcactgattccgccccatgctgcgttcattgcattcgccgtgccgtcctcattgtatgttgcgagaataaataccggctgtggataggtgtatggttttgctccaaaatcttttcttgccatattaattcactccttttcgtgctctgttttgaattatttggaaggatgaactccttcctctgttttatacctcacatttttgcaggaatcaagagggggcaggacatatacaggttttttgtgggattatgtcccacggcttttgcttcttgggacatatgtagattttgtgagcaattatgtcccataacatctggtgtctgggatatatagaagatttttccggagctatgtccctctttcttggacacacgggactttttctcctgctttttcgctatatgtccctcttctttagacttacgggactttttcctctgctttttctttatatgtccctcttccttggactcgcgggactttttcctctgcttttttctatatgtccctcttctttagattcgcgggactttctcccctgcttttttacatatgtcccatctaggttctgcaatagcatgaaatgaaggtgatatacttttatatgccccaaaattatatagctaaatacagttcgcactccaagatttcacacaggcaaaaatggcattttatataattatatctctgcacatactttgccaagtttttttgcatattcataaagctgcctatttttttcattataaggaccaaattctgtcaatgcgcaaatgcaggcatcacagtcatcgagcatctgttttgcccgcaaaaaggtttcttccgaaaccggaaagaatgctttttccgaaaaaacacaagcggcaagtgcagatgccgctgcgtactccacatcattttcctgcagaatgcctgctgcaaacggaatattctgccgctgcaggcggttgtaaaccgcaagccctgttccaccaccgccaatcacaaatacctccggaattccttccggtctttccataaaaacctgtccggtctgcggttcaaactgctgtggctttacaccgtacaactgctgcacgtagttcccggaaaagatttcctccggtgtcccgacccggtcaatacgatcccctttcacacacgcaatggtgtccgaaactttctgtgccagatccagttcgtgcaatgacatgataactgccaggtttttcttccgtgccagcatgcggatggttgtaagaatgtccagtttaaatcccatatccagataggaagtcggttcatcaagaatcagaacctgtgtgtcctggcagatcgcccgcgccagcataagtctctgcctctgcccatcactgattctccggaaatcctgctgctgcacttccccggcatgtaccagtgcaatcgcttcatctactttttcccagtccttgtccgaaaggattccaagtctcccggtgtatggatagcgcccggttgccaccacatccctgccgcttaacagttccgtgtggatgcgctccgtcatgaccatcgaaagatgtctggaaatttcactgtccgtcagttccctcatggattcttttcccagaaaaacactgccgccaatggttttaagctgtttggtgatggtctttaaaattgtcgattttccggagccgtttggtccgatcagtgtgaggatttcccctggccggacacccagattgatatttttaatcaggggaatccggtcgtatcccacagtcagatcacgcatcgtaagctgctcggcatcgtttggtatatcttgcgcaggaaactgccctgactcttttagcatattctgcccgttatgttgttttccgttttcttctttcatcactttccaattattttccatttgcatttttgtgtctgctcatagtaactttcttcctgcctttgcgtccttatccgttttggctttctgtctgcacgttatttttcttccacgattcatcacatctgctgctttcgcaacattgccgcaattaccaccggcactaaaaataccgccgtcaccgaactgatactgatctccgttggtgcaaacacggtccgcgcaatcccgtcacagaacagcgtaatcactgccccgccgagaaaacatcccggaattagaataatcggttttgccgtgtgggttgccagtttaatcagatgtggcaccgcaatcccgacaaacgaaatcggtccggcaaacgcggtcacacatgccgacagcagacttgacagtaaaatcagtgcaatgcgcagtgcttttacatttacgcccatatttctggcataggactcgcccatctgataagcactgatcggttttgcaagtccgaaggtaatcacaaccgtgattccaacaattatgaccatgatgcgaatgtgctcccagctcataccggaaaaacttcccatcgaccagttgtgaagattgacaatattggaatcgtccgcaaacgtcacacaaaaatccgtaatcgctgaacagatataaccaatcaggataccgcacactacaagaagcgacatattcgatacccgaaacgaaatcagaaggacaaatcccatggcaagcagtgaaccggcaaatgcagctaccaccattccaagggaactgaccataatccctttttccagaagaaagatcatggtcagtgccacgacaagtttggctccggaggaaatcccaagcacatacggtcctgcaatcggattctggaaaaaactctgcagaaggaaaccggatacggaaagtgcccctccgagcagaactgcagcaatgatacggggcagacggattttccagacaatctgatacagtgtggaatccggctgatgttttgtcagcacgcccagaaaatcaaaaaaagacatttccacacttccgacaccgatattccagaaaaacaaaacgaccagcaatcccatgatcacaagaaaagaaaccagatagcggagcgttctgtttgtttctgtcccggaattattctttttttcttttatttgtgatctcatgttctgctcctcatgcattacgacaattgttattatttgtacatccgtacgctccggctcactgcaatttcttcagaaaccggtatgttccatccccttctcccgtcagaatctgattcagatcctcgataaaatcacaggttccggtagactgctggtaaaaattgcttcccgttgtatatacctgtccgctttttacagcctgaaaatccgcaaacaagctgtttttctttaccagctcatcgatggacgtcaattccccctcaatggttccgttgtagatcagcacatccgcatcaatctccgcagaataaaaatcttccatctgcattttcatcgtggaaagtgcatttttttcttcatccgtataatttccgagtgaataggtcccgcctgcaagtccgatcatcgcagagacatagtcgtttggcttgcgcacagtgatcgtcccgtccgaggaaactgcaaaaaatgccacctttttcccggtactcttttttcccataatcggtttcacacgttttacctgtttattaaaatagtcatctgcctgttgttgttttccaaacagaataccgaacaatttgatccattcaagccgtcccagcggatgcttttcataactggaacgctcgaccatcacccggatgccaagttcttcgagtttttcctttacttccggattgtgcgtgaccatcgtattttcaatggcaaatgtgcagccaccctgcaacagctgttcgtaatccggcgcactgtattttccggcataaaccaaagaaccgtctgccatggcatccttcgcctgctgcacataccagtcatcttccttcaatgcggtgtatgcaacgtgtgacagcccaccgacctgacagatcagatccatcaccgcagacgatacaaggtacacgtggtttaacggctgctgtaaaacggttacatcctccggtacatccgctggcaccggaacccctttcggaataagcaaaaaacgaccgttgtccacgatcgtaatcagcttataatttccatattcatcgatctgaaactgatcggcataggacaattttacctgcccggtctgtttcagctctttaaaacttacatcttttgcaaaagaaaatgtcagggtgtaatcaatctcatgcggctggctcatggctgtagtgtctcctactacatccatcgtacacggaactccggcaattggaaatgtaaacgttgaattcccgccctcgttctcatttgtatatttttttccatcgaccagcatgtaatcgtaataggtactgctccagactatggttgcatatgcctgtccgtccgtcacttttacttttgcttcagaatctacggaagctctgccgcttccgccttccagttctacatttacggtgtattctccgtcttccagcgatgtgtccggttccgcggtggcagtctgcgtttccgcggcatgctgcacctgttctttttctgccgtagaaccacagccggacaaaaccgacacacacatacaaagggacacgataattaccgttaatttcctgcttttcatactttttctcttcgaccggatgatttctccgatccatcctatctgttttcctgtaacttctgacacatgtacatcattttcaaatacgatgtaccggaattgccgccgtctggcagacaactcacattttattttttctgtgcatctgatacactgactttatgatcataccaggttcccttggttccaagaattgcaaggtcaaactcttttccaagttcttctaccggcacgtcaaatccgtaaacttcctctgtcgttccatcgctgtattttactttatctgtcgttggctgtaacaattctgcaccgtctttttctgcatcttttgcacttcccagaaacagatttacgattttcttggataccagacgaatatgaatggtcatctttttgtcttttacggtaagggttccacatccattgtctgcttcattgacatgaaacatcccactgtcggtattaaactttgcggtataagtgccgtcctccagcgcggataccgcgctggaagaagcagacttggaaacttttccaagtgactcaattgctttttttgtatgctctacataaagtttctggacagcttcaatctcaccaagtccggcaatctgtgtgtcaacactgtcgaaattgccgcttgcagtgaactggctcttccaggaatcgtcatcgtctcctgccatgtcattgtttgcatgatctccggcaacaaccatgagtggacgaagaataactttcttgtaacctgcgtccttaactgccttgattacattttcacaggaagtctcttccggctccccctctacggttccgataaagacattgtcataaccaagcttatccatctgtgtagacatctggctgtaacttacttttgcagaatgggaagtaccgtgtcccatgaatacaaatgcagtaccgtccttcttggcagcatccagtgaatcgtatcctgcggtttttacggcttctgctgtaatgtcttctgcaactgccttcttgtcatcgttgatcactgttgcatcatcaccaacttcgccaagcagcggttccgcaacaacaactttttcaaacttatccttatatgcatccagttctccgacaagttcatcatactctgcaccgtgcatcaaatgtgtcggctggatcaccagattctttaccccgttatcaaccgctctctgtaatgcctggtcgacgttgtcgatcttctcgccatctcttgcctgtacatgattgataatgatctgtgcggtaaatgccctgcggactgcccagtccggatttgctgcctgaatggctttttccacaccactgatatctgcgacacggctgtcattaaaagatgtaccaaagcttacgacaaggatttcattatctccgatattatcctgatttaacggatcatccttggaagcatcaccggtatctctgccgaaataatccggatctgcattttcaccggaaacaagtgctttctgtgcatctgtcagcttgtcccatgcttcttttgcagcagcacactgctcatcggttttatctgttctttcctgaacataaatagcatcaattaattctgctacctcatctgcagctgcctgatcgtcttttgcagactctgtgccctgcgaattttctacctgattgttgtctttgctgtctttgtttccgcatccggcaagcatgcctgcagccagtacacatgtcagaaacaatgcaagtgttttctttctcataattctctcctttgcttgggttagcgggttccttcatctcataagaccacacgccacccaaagtaccaaaagaaaagccccgcccggaacattccgaaaggagcaatcaacccatgcaaaaaggaactgtctgtggacggctgtcccacacagttttctgtaacatgcagtacgatcaatgactcgtgatctgaaagtaaaaactttctgtaccagatcattggcaggtttcctggctcatagatcatcataacatgcttcaccttcccaatgcagttgcatcagtggcacctgaaatgcagcctaagctgcatttcctacgtacaccgcatccgcgccagcggatttctcatgcggtgtgctccttcttgaaatgcagcctaagctgcatttcctacgtacaccgcatccgcgtcagcggatttctcatgcggtgtgcttctttgcagttactccctaatcacagtgacgagttcgtacaggatttgcacctgtttcccttttaccctgcgcatacaagcccatatatcccatgcaaagcggttttatatgacaggcaccaacgatcttctttatgaaactttttacatattagcatattgcgcgtttatttacaatgcgaaaattgcatcagatttccgtcgtttacagtaatttttattgacagttcatatacccctgcttttgacacatcaaaaaaactctgcataaactgtataaacacagtaatgcagagattaaaaatatgtgtgctatttacttttaacaattttttcgacttcatccggattcggcatagaacgaatcgcacccttttttgttgtgacaagatatgcagcagcatttgagattctgagcatttcaatcaattgttcttctgtcagatgatcgacatcatgctccaaaagataatttaatacactgccacaaaaagtatctcctgcccctgttgtatctactgtccctcccagcagatacgatggtacaaatacctttttcccctgataataggaataacttccatctgcacctgcagtcagattcaacaatcgaatattcggatattgatccatcaaaatctgtacaccttcatcaaaatctgacgtatctgtcataaattcaatttcattatccgaaattttcaaaacatcacattgacctaacccatatgcaatctgaacttttgcctcatccatacttttccagagcggcggacgaagattcggatcaaaagaaattaataatccctgttccttagccaatgcgattgcctgaatcgttgcttctctaaccgtttcatccgtcatggataatgtaccaaaatgaaaaatttcagcctgccgaatcagatcataagcaacttcggatgctttcagcatcatatcagctcccggatgacggtaaaaggaaaattcacggtctccgttttcaaagtttttcacaaacgctaatgttgtattataatacggatcaacaatcagtcccttgtgatcaattccgatttcatccagaatatctgtcagcatttttccgaacaggtcctctccgattttgccgatgaaagcacacgatctgtcatactttttcaacaaggcaagcacattgcatggagcacctccgggatttgcttcaaagacaggatttgtctgctcacttatgccataatccgtaaaatcaatcaatagttctccaagagcgatcacatcatacttcttcatgccgcttcctcctgcttaaccaagcatataacgttcaaattccaatgctgccttagcatcccgatccaacgcttcctcactggtatccgggacaatatcacgccatattttaatattctgtcctaccgttcctcccggcatgacaaaaggttccataactacggtcttatcatattggatatcgcgaagtgcttccccaatttcccgccaaggtgttcttcctttgcccggaaccatacggttgcactcaccggtatgaaaatgtccaagcaaactgcccgctgtacggattgcggcgccgatgctctcttcttcaatattcatatgaaaggtatccagcataacgcttacattggaagcctttggctctaattctctgacacttttaacaaaggaaaccccttccgctgctgtattcagcacgtggttttcaaaacggttcagacactcaagtccaagcacttcaataccacattccgaagcaattttgccaagttttgccatgccttcaattccgcgctcccaatcccccttcttgtcaaccggtttcgaataatcaatcggccagcaggaatagagcgccccaccaatgagagttgccccgattttttccattctctggaacaaatccgtatagaacgccaaagcgtgcttacgcacctgcggatcactgcttgcgatgttattttccggtgccggaccatatcccaccgtaaggcgaatattctgctcctttgcatgctcctttagtgcctttagatccccatcactatattccggaagcggacctgcggcaatttctaaaatgtcatatccaagctttgccaccttatcaatataatagtggtaatcgccatcccattcatgttcccaatatgcataataaattccgtgttgcatcacgtaccctcctttgctattttgacgctgccttttttgcacgtttctttgaaatcgtaatattaaataccagaaccgcaagtaatgctactccccagatcatgtcccggtagtaattgctgattgccgggaactggttcaaataagaggacaatgtctgcagaataatgacagcaaaagcgataccagggatgttaccaaatcctccatcaggattgattccacctaagacagcaaccagaatcgtctgcatggtataacttgttccgaaatcagcctttgcggaatttaatctggacaaacttacaagtcctgcaatcgcagacaggattccggaaatcatatagcagcataatgttgtcttctttacattgattccggcaaattttgaagattttgcatttgttcctaccagatacactttatttccaaaacttgttttactcatgatcagagtcaaaataatggtacaaagcaaaaacagaataaaagggaatgggatcccgaaaatggtcatcgctgaaagaatgttaaactgaccgtttgcggaaacagtacttccttttgacagtacgattgatattcccatatacagttcatagcttccaagtgttgccagcatcggtggaatgttaaggaagctgaccaaaaatccattaaaaataccgcataaagcacctacaataagtgcaacaacacatgcaagaacaattcccgctacgccgcttgtattgctctgaatgatcagtcccgcgctaataccacaaagatttgcgatatagacggttgacagatcgattccaccactcagcatacagacacccattccaagcgacataagaccatattctgtgagctgcttgccgattgactgaacattaccgacatttaaaaactgtgaggactttgtaattcctgtaataaaaagcagtgccactagaataataattaatcttcttgaattttcatcgaaaggtaaagtcataccctttttcattttctttgcttcattcatgtctacgctgcccccttcttttttgctgatgtcctggatgcccgcatcgcctgcatcgcggataccgctgtaccgataataatgattgctccaataaatactttttcccaatatacagagattccaagcagaatcagactattggaaaccatcgtaagaagcagggttccgagaaggcatcctctaagtgttccaataccaccaatcatacgtgttccgccaagaacaactgctgcgataaccagcatttcctctccggcatattcattcggcagataaaaataagacatcattgcataacagagacctgcaatcgctgcaataccgccatttacaacaaacaccagaaatctcacttttccaacattgattccggctctttccgcacttacttcgtctcctccaaccgcatacacacttcgtcctgccatcgtataattcaggataaaatatgcaatcagataaagaacgatcataataacaaacgtaaacggaagtgaagaactaagaccggactttgcattggttaccgtaaccagattaatcttacttaatgcataaagtttctccgggagttccgttcttcccgcttcaaacgtaccaaataaaataccgctgcagatcgacgacgtaccaagtgtaacgatcagactgttaaacttgtatttcactataaaaaaaccatttatgcagccaatcaggcagccaacgacaatggcaatcgcaaaaatcggaatgacacctagcgaaaaacgatttcccagtgttaccgcaatatacgcagacaacgctgcaattaacggaaacgatacatccgcaccggtacttacaaaactaagtaacgcacatattgcataaattcccggtatgatcatggagcgaaccagatccattaaattattgcttgtaaaaaacagcccggaacgtacttggatgatgagtgcgaatgcaacaattatacaaaacacataaaactctgtttgtttcaataagcctttcatcttaagtttcatctttccactcctctcctatattgtagacttatacagattatcatctgtaagatcttcacctgtaaactctccggtcatacttcctgctttcatgatcagagcgcgatcacataacgctgtaatctctgccacatcatctgatacaaccagtaccgccatgccctgttttgccagttcccgcagcaatttatggatatcatactttgcgccaatatccacaccaaccgtcggaccgttcaaaatcagaatcttaggatgtgttgccagccatcttgcaagaaccactttctgctgatttcctccggaaagcgtctgaaccggaagcgtatgatccttcgtcgcaactccgatttctttcacccaatgttcagacagttctttttgcgcagattccttcacgcttcccaacacgccggacagttctttcagacttgttactgcaatatttttataaataggctgtggcaggaataacccttccgtcaatcgatcctccggaaccagcgcgatgccatgtttctgcgcctctgccacatttttcagttgcacttccttgcccgaaatacaaatactgcctcccgttggtttcaacattccaaacaatgcaaggctcagttccgtacgtccggatcccagctgtcctgcaactcctaaaatttctcctgcatgcagatcaaagcttacatgttcaaatccctttgcggataagtctttcacttccagcactttttcagctttcgaaaaatcttttacctcttttacttcagaagtatcgatatttcttccggtcatataataggtaaatttttcttctgtcatctcactcgccgggcaatggtatacattctgtccgcttctgagaatggtaatgctgtcagagatttcaaatacctcatccaatttatgagaaacaaataaaattgtaatgccttctttttttaattcttcaatgattccgaacagacgcgttacctctcttttggtcagtgcggttgtcggctcatccatgattatgagctttgcattatgaagcagtgctcttgaaattgcaatcaactgtttatctgcaacgggaagtgtctccactcttgcgtcaagatctacatcgaaattaatttttttgacagcctcttcggctatctttcggaattctttcttattaacaaatttcttcttttcagctaatacctgattaaatgccaaattctccattactgtgagattcgggaaaatcgaaaaatcctgatagattacctgaatgcctgctgcaatcgcatctgctgtagacatatttgtatattcttttccatcgatttcaatggttccttcatccggtttataaaacccggaaatcacttttataattgttgattttccacatccgttctcaccggcaagacaatgtgtctctccctttttaatggtcagatcaacaccttttaatgcatgtacaccgccaaatgatttcttgatattcttcacacacaaaatattttctgacattggttttcactctctttcaaacattattcatttacaggaaatccggatgcttccggtttcatcggagccactgcgaaaactcattttaactgcttcacatatccggatttccgtcaagatttataaggagttttaaatcgactctaaaatttagaagtcatagtcgtcaatattgtccgtatttaaaattaacggagcatttcctaatacacaacgatttgcaccttcctgaatggttacgctttcatatccgtcctgaccaagatcaatgccttctttcacttcttcacctgctaatatcttataagccagatcacacatcgcataacctgctgacgccggatcccacagacatactgcatcaatggttccattctttacatactctcttgtagcatttggtgtaccaacacctacaattgataccttatctgtaaggcctaattcttctgttgcctgtgcttcacctaagatatcgacggaggcagcacccgtaaatcctgccagttccggatttgcctttaataattccttagccttctcgtatgccgtatcgactttttcagatgactcggcagatggtacggtatcattaattaatgacatatccggataatttgcctgctggtatgcatactccgcattggaatactccatatgggttgttgatgtcgtgtaagcaaccatctgcgcatactgccccttctcacccattgcttttgccagttcctgcatcattgtgttaccaaaatcttctgctgtaaatgcttctacatcatataatgtattcttaagatcagaagcttcatggctgattacaacaatacctttttccattgccttctgtaagacagactcaagtgcgcccggatcgattggaacaatacaaatcgcatcgactccctgattaatcatatcttccactaactgaacctgagacgctgcatctgcattagccggtcctttctggataacattgaccgtctttgtctgtccaaactcatcaactccgacctgcatacgcttaaaccaatcggaagttccgtcttttacaacaactgcgatcgtccaatctgctgcctctttatctgatttatactgtgttgcatctaataaatctgcgctcacgcttacctgcgtatcggactttgtgctaccgcttcccgatcctgtatcaaccgctgaacatcccgcagcaccaatcatcattgttaatcccaaaaccattgccaataatttttttgccatatttttgtccccctttgacaatctactcaatatttctgtgacgggattccatctcttctttggaaattcccatttcttcactaatcatcattacaattacatcaaaaaatacaagtaatgcctgttcaaactgattccccatcatctgaaccgtcggtacatattcatcctccgaattatataccgccttataagccgttgccggaatccgaatcaccttatctgcaatctccagaatatgtcctttcgcagatggcgtaatcagaataagcgttgcgccggttttctttgcattgtcacaaagtatattttcatgcgccacgtctgcgcttccgcatgcacagatgaacaaatcacctttgcccattgatggagttgtatcgtcccatacccaatgagactccttccccaaatgcattaaccgcattgcaaactctctcgtcgaaagcccttctcttcctgcacccagcaggaaaatacggtctgcttttttgatttcctccaatagttccctgacattttcatcgctcattcttgcaaaaacttctgataactcatccaatgcaatctttgacaactcctgaaaacgatccatgttacatcacctcctggtattttttatgatcaaggcgactaagcgcctgcatgccatcttcatgtgtccctgtataaccagagaacagccacgcatgaatcattgccattgtgaaatcaattcctttcttctccataaaccatgcgcccgtacacaaaacatttccattattatcattcttgctaagaaccgccggaaatacatcgtagcaaagcactgcacgaattcctggaatcttgttagctgccattgccattccctgaccggttccgcaaataagaattccataatcgcattctttgcttatcactttattcgaaacaatttctgctatctctgcatattttcctccatccgcttcattttccgactcacaccctgtgtcaataatgtcatacccttcgtctttcattctctctaataatttctgatagaaccgatacgctgccggatcacatcccattgctaatttcatatatcttaccttcctttccttttaatgaaaccgctttcattgttttgtaataagtaagtgattgtgtattttatgagtaacacacaatcactcttttataaactagaacgtctgatgaattaacggagaactcaatatcatgtgctgatatgcttcctccggctgttcaatcctcttcatcagtaattcggccgccgaacgacctaattcatatgcatcacgctggatacaattataaggaataccaagatattgcatcatatcaatctcatccagaccaatatgtgtatacaaatcggtttttccgtgtgtatgttcacataccgcctgcaaataacccttactcaacaggttattgcatgtaatcacagccgtcggctgatcttcctgtgcaatcatcctctttgttacctgataaccagacacccttgtataggaacctcttaatacaagcttctcatcatactggattcctgcctgtttgaggccttccagatagccttcaaaacgttggatggaaagaatattttcttcctcacctataataattgcaatcttactgtgcccctcattcgccaaggcaagcactgctttacgaaccgcactctgatcatcaaaatgaacaatatcgcatttgagtccaacgtctcgatccatacatacaatcgggcaattcatccgatccagctttcgctgcaacttatccagaatgcctaatgctgcatagttcactgcaggaatatataataatcctctgacccgctgcattttcatcatatccaaagctttataatcagcctctttatcattgtcatttccagaataaagcagagaatagttatgtttctttgttacatcttcgacccctgaaaacaattctccgaaaaaggtattactgatttctggtacgataacaccaattgttgatgaacttttcatagaaagatttcttgccgtctgggatggtgtataatgtaactcttttataatccggcttacagtttctcttgtatgttcttctacaatatccggagagttcaatactctggataccgttgccttggagactcctgctctctctgcaatatctgatattgtgatatttttatcgatagttaacgcctccttatgtaaccgttttcattgattgcattatatgcttatgcaaaatttatgtcaatacatgctctttgttttcgttgtattgcacagttttttctctttttcagatcattttccctatttattttgttatttttgccatgtaaccgtttacatttccatacatgataatattggctttcaaattttatacttaccatttacccgatttgacgatgtattgtttaaaacaactcagccgttttgatccggcacaccacttccgctccagactccgcgtggttgtaaaaacaaagcatgccgccctgctcttttaagaatttttttgcgatcgcaagaccaagcccctgatgcgtccggtcatgccggctggcatccccgctgtaaaattcctgatctgcatagatgagatcctgctccgaaaaaccctttccaaaatcgcggacggttgcagtcagatactcctgcccctcatacacttccatctgcaggcgcaccacgatcccgcgcgcccggtctgtgtgttccaccgcattgctgaccacatttttccacgctctgccaaccggtcctggcttgcaacatacattcccacacagggaatcctcctgaaaatcaaccggaactttttccgctgccgcaatctgcatggctgcttctttgaactgctctttcaaacgcgcacaggtgactacttctgtctcctctgcgcggtcacgtccatacagcagttgccgcatatgctccaaatactgctccatgctgcccacattcgccaaaatagcatccgtacactcccggttttccgcagacaaatccgtctccgccaaaagctcggcatttcctttgatgacagtaagcggtgtcttgatatcgtgtgtcagtgccgcaagctgctcttttttctgctgctgtgcgtcccactgtctggtcagcgaatcttttaatgcttctttcatgccggaaagtgaggacatcacatcgtcaatctccttaatctgcgatggtccggtttcaaactccagatcattttgtccaattttttccgtaacttcgcgtagctgcctaagctcccgttttaatttttttgcaaaatgaccggacaacaatgtggcgtgcaggaaaaacagcaccacgccaagcaccggtgtcagtatctccagagatggaacaatgccgtttaatttatcgtacgcatacctcatatgcaaatcgtattttacaatacagatatcgccgctgttctgcttaatatagcggtaatactttcccatggatgcatacttactgccgtttttatacccctgccatgcccttttctgcgcgtctgccaaaaaagttccggtcttaaaccgccccgtcgcatcgtaaatcccgtatctgcatccatctggaatcagggcttccacatctgtccccgcagccttaatttcttccgtatggtccgtcagttgcagctccgcataattggcaggcagcgtaaatcctgtcatgggacttaataccagaagcaccagacagaacattccgattccgaacgtatccagacagaataacgccgcaaatttcaaaaacagcccggtcagtgttttttgtcttctttttttcatttccatcgatagccgatcccccaaaccgtttcaatcgggttgatcccaaatttctggaattttgcacggatattttttacatgctccgtaattgcggaactgttgctgtccccgtcaaatccgaatacatgctctaaaatccgttctttcgaaaatacctgtccgtggtttaatgccagaaattcgcagatcgtatattccgcctttgtaaaaacaagttcatgttcctgcacatagatttttctctcctgcatggaaaaacgcacctccccgatacagatcgtatgcgttttttccctgttttcccgccggatatgtgcagcaactctcgcccgcagttccccgatcccgaacggttttgtgatatagtcatccccacccgcgccaagcccggtcattacgtctttctcttcggtttttgccgtgagaaacagaatcggacaatccactttttcgcggattctgcggcacagatcaaacccgtctatgcccggcatcatcacatctaaaagaatgagctggtatctgcccagtttgtcttcctccagttgcagcggatcttcaagtgccgtcacctgatacccttcccgcaaaagtgcttttttgatcacagctaaaatttcccggtcatcatcaattgccaatatctcagtcattgcactgccttccttcatatttatgaaaccatactccgattatgacacacatcagaaacaagagcaacagacaaaacaacacacgtttcccgtttacgggatcattgcagtaccgaatgccccttgcactccacgtagccggaaaaaactgccatctgccctccccaagcccggtgagaaacagggcggacaccaccgactgcaccacgcccacgcactgggatacggtctttggaaagatcagattcaggaacaaatgctccagatacaacggcacacttccgaaaatcagtgtccccgtcagccgcacataccgcatgccaatcccctcttttcccagtaaaaaatgatacccggcagcaaaaagaactgctgccccgaaaattgcaagaaaccccatgccaaaaagaaccacgccctttacaacaaatcctttgccctttactttgtagttcccgagaaatacctgaaaatgattctgctcctcaagtccgatatttcccgcacacacaatgctcaccacaaacggaagtccgataccgatcagttcaaaatatgccatggtctgtcccatgggatttcctatggtcccgcgataataaaacagcatgaaaccagcgatgataaccggcaccgccacatgaaacggaattaaaaaagtatgcttcattttcaaaagttctgcccggacacttcccatcacacgttttgtcattctgccacctgctttcgaaaccatgttctgcctgccagccagaataccagaaaccacagaagtgcggcaggaattccaatcaacagcccactcactctgccgagttccggagaataggtcacctgccccggctcaaacggcagtccgtttggcatcactttgatcacgacacacatcagccgcgatgtgatcgctcccggaaacaacgcaaaccacggttttaacgataccgacgtagacaaaatactatagattccaacatggatcacaagcatcagaaatgtgcttattttctgtgcaagaagcaggcagaacggaatctcccagagtgtggtaagccacaacacaattcctgccagtatctgtgccggaatcgggattgcctgcctcatcttcagattccccacagattccagcagcatctgccccatcatggaaaacagcgtaagtccagcaactgcaaccgccgacatctttattccgacaaggatttttgcgtcccagatctgttccatgccgcagggcagtgaccatatcgtgtaattctttttctgtttgtcctttttcccgatgatgctgcacaaaatgcccagaaaccccggatacagcccgatgtaccaccagttgtacacatcaatggaaaaataggaagaggtcagccagaatgccagcaacgccgtaaacaccggcatgccgagcgtaattgctgccacggaggtatgacggtattttaactgttccgcctgaaaataatgtttcatgattcattccctccttttgcgacaaccttcataaacaatgcttccagatcctgctgttcctgcagttttccttcaaatcccaccgttccctttgcaatgatcccgatgtaatcggcggtctgctggatttcacttaaaatgtggcttgaaatgatcaccgtaatgcctttttgcgggaaactccggatcagtgcgcgcagctcctgaattccaagtggatctaacccgttgaccggttcgtcaagtaccagcagtttcggatcattcaaaagtgccagaccgatgccaagccgctgcttcattccgagggaaaaagcccctgcttttttctttcccgtatccgtcaggtcgacggttttaagtactttctgaattttttcatccggaattccgagaagaagcgcgcgcactttcatgttctcccacgccgtcagattttcataaatgggcggtgtctcgatcagcgcgccaatatccgccagatctgcccgcgtccacttatgcccctcaaaataaatttcaccggacgtagggtttaacaatccggtgattgttttcaacagcgtggattttcccgcgccgtttgcccccaaaagtccgtatacacagtttttggggatttccattgtaatgtttttcagaacgttttgtcctttaaattcttttgacagatttctgattgtgatcatattctgttccatgtttcatcctcctcttgatttgtaaaatcagtataaaggagaattctaaggaatttataaggatctttttattttatctgcagctttaaaaatgcctgtttctgcgacggatcttccgggctttccacagcaggattgctgtctgcatggcataactttttatattctgcgccgcatcaagctttttttgcttttccaacagctttaccatggtgtcctgatacagttcgtttccacgctctgtactcccggcattcatcctgcagaaccgcagaatgtcttttccatgttcggtgacaaactgctcaaattcgtgcttatccatccctgatcctttttctctcttaaatcgatttaaggggtttgcccttacacttttatattgtcctgaactggcaaaaaggttttatttatactataataatatcctgaatcatcaaaaatgtctccgttttttttttcaaacatacttaattaacgacaaataggaatttccataatagaacttgcagttaagaggcgcctggaaaagatatgcgaatcccataaactgaaataaacgtaaaaacacccggttaaatcacttgatgataaggactggtatctatagataaaaaattaaaggctcaggtgacgttttttcgaaattttagtgcttgaaatcaggaaatgtcacctatatagtaaaaattgcttttccaggtaccgcttttttcgagaaagtggtacctggaaaagcaatttttgatctatagagactttccggtatctgaatgttaaattttcaatatataggtaccgcaatggtatcttttacatgaattttattggcatagataccacaatggtatcttttacatgaattttcttccgggagtgcctttaactgcaggttctggtgcctttatatttgttccacagacaggatttgcggaaatatgtttctcaattatattttctccagcaaacaggaagaaggggaacatttctttcggaagaacaaatttacaacttgctctggcactcacaacccacagcgaattgcgtaaaccgaacaactttactccacgtacctgaaaccaacgccagagctaacttgtaaatttttctgtagaaagagaatgtcccctttttccgtcacatcgagaaaccttatatttagaacagtctcccccgcaaatccatccctctgaacagaccacgcagttaaacagcaatttcaaatatcactattttttcccgtacattgtttccgtcaaacagatctctgcaatcaatttcatcggaaaacaacaattcctctacggtcatcagataagctatgtattcatccgatggataatagaaaaacaactttactgttctcctgttttcataataagaattcaaaatccgggcaattacttttttcagcagttccagcgaaaaaggattaaaaaaataaatccggtccaccgtttccggaactgtataccgctccgcatttgcaagtgcaaataataccctgccggaagccacggcagactctttgttattcatagccttttcataaattcgctcgttatattcgacaccgatagactgacatctggtttgatatgacataaaaaaatcaactcttccttttccgcagccgtagtcgagcaatgtgttttcctttcgaatcagtccgctgtttgccagacgttccaaaactgaataaggcgtaggttcataaggataacgatactgatccgcatttgtatcgtctctgccagtggtgcgaaccgcaagaagcctgtcccatcttgtctcgttcttttcctcgttcatcgttttcctttcctgattaaataataattccgttgcaatgatcaatttcatgctggatgatctgcgccgtccagccggaatattttccgtgctgtggtttaaaattctgatccagataatctacttcgatctccttatatctggtacagtttctggctccgtcgagtgacaggcagctttcctcggtctgatactccccggatttctttgttatcacgggatttaccattgcaaactgaaacggtccggccgctacaacgataattgctttgtttacgccaatcatatttgcagccatgccgacacagatttcccggttggcacgcatggtgtctaagagatcggtgattacctgcctgtcggcttctgtggcaggggttgctttttttgaaaaaatctgtttgccttttacgatgtttttaatcataatgttatctccacttttctttttacagcatacagcagtgtatcatttatcagatccgtaattcgatgaagtttttttcatacaaagacatcgaaaaactgatggctgatttgaaagctgtaagacggttgatttattccaccaatgcaattgaaggattcaaccgtcagctccggaaaatgaccaaaagcaaaacggttttaccgtcggatgacagccttttaaaaatgcttatctggcagccatggatatcacgaaaaaatggattgaccacaggcaggactggggtcagatccattcccagccggaactttattttgaagaacgtctgaccgggctcctatttttgtaatctcttcggtaaccagcttcatctggttttcaccatagatgactttcacttgctttattgaaacagattttgtttccccatatacctttttaataaaaaagtacaaaaatacggaaacgtgactatattctcactgattcccacattccccgccatgagtttaattccatgcttaatatctgtataagtatcactttttattagttggcgcatagatttggcacgattcgtatttgcttttacttctactggaatcagttcatttgcgcttcgaataaagaaatcttcttctaatgtagaattatccttcgaataataataaagcccatatccctgctttaccaatgcctctgctgcaaaattttcataaagcgcacctttataaatgccaagatttttatttgcacgcaagtcaatttgtgattcatcgtccagacttgccaccaataatccggtatccgaaatatatactttatatttgctttcatccacatttccttttaatggcaattccggaaattgcaaacattcacatacattaataagcccggcatctttcaaccactctacacatcccatataatccttagatcttccgcccttagagactttcgaatattgaaattttttattttctttggcaagctgtgctggaattgaccgatatacactcagaattttcgccttatccagcccttgtgcatactttacaatatcattttcataatctaccaataattgatgctgcaaatcaagcgaaccctcaaaagtttctctttcaatataacttgatacaatcgcaggcatgccccctaagatacagtattccagaaaaaggtttgaaaaaatcatttgctctgcttcggaaaaagcaactccttcaagcatatgacaaagcatatccgatattgcttcttccgaatacccttttgcccacaaaaactcttcaaaatccatggagtacatctgataatctgttttataccccacactgatacttgcaattcgctgatactgcaccccaagtaatgatccggaacatataacgtcgtattttccattttctttaaaaaatttaagcgcggttgcaatctccgggaaatcctgaatttcatcaaaaaaaatcagtgtttcgttttcttcaaaatgtttcgtcggatcaatcctgctgatcagcttgataatatgttctgctgaaaacccttcctcaacaataactttataagatggctctgtaataaagttgatctcaattacatttttataattttcccgcgcaaatgttctgatcgtctctgtttttccgacctgtcttgcgccctttattatcagaggttttcgatctggatttttcttccactccctcaaaaatgcgtctgcttttcgaactaaatatcccatattgtgtacctccacagtttaagtgtatctattatacaccttttaatgcaaacttttataaaaatttacatttttatgggcgattttttcttcaatattacatttttatgggctaattatatttattttttacatttttatgaggaaatttacttttttcaagagtctatcttgatcgtttctatcaatttttctgttgtttaattaggcaaatgttaattttttaccaaccgtaacgcatacctgcataaaaaattgatggcttagaatacattgttccaagccatcgtaaaaagcttactattctgtcgattctgccgtatccggcttcacatgattttctttgatatcccatgtgatcgtatactcttttcctaacatcgtacccatattttttacataatcctctaacatagactgcaccctttgttgtgcctgtgctaataaaacagtatcatttgctgctgtcttctccatttctttctctgcctttttataggctttcgtctgatcatctgcatccgctattgctgaattttttgcataataataggaatccttggtaatgctgtcgggatttggttttgaacttaatacctttgcttctggaatatgtatttttacattttcaccatctacttttacatctaactttgaactatcaatgccaagtgtaactatcccatcataactgatccaaaaatttttatcttttttccataataaataaccagaagcattttctttcttttcatttttcttttcctcataaattattgtttatgacaaagaaaaggacctttcgatccttttcttcatcccaccatcataaagcagatcctattggatttctgcaagctttttcacaatacgtgcctgcacttttgtatagtaggcggcatccgcagtcgacagattatccgtatctacgtcatttaacttctgcatgtaatcggcatatttcgtcatataatccgcataatcatttaacattcccgccacatcatcagaattttcatactttttcataaactcgatatattcatcaaagaaatcttcataactatccatcatcttcttaaaatccgcatcaactgccccatctttctttttagaactggttttctttttctccttcttatcagtctttgaggaatctttggatgtatcttttgcgttttccgagtcatctgtttcttccggctcctctgtttcttccggctcctgcgtatcctccgtatcatcgtccaggtcatagatatctatattcattgtctttttccttttatcataactcagcgagagcgtatatccatctttattctctgcatcatatgaatcttccgtcccataataatccacattaaatccgttttccttacatgcatttatataatctgcaaactgtgatttcgacgtattaaaaacgtcaatttcaaaagaatcttctgcatccaatacaatttctccgtatttcgattccggaacaggcaacgattttaccagcgtacttgtcggccaatgatactctgtttctttcgtcttcatagcattacaaccactaagatttcccaaaatcattattccacaacacattaccatcattaatctttttttcatttctctttgtcctcccttttttgatcctgcttcatttttctcaacactgctatatgatccatataggtcttttccacagtgttttcctctgtcggaaccggtaacattccattttgctgcacatatgaaataaattccatctgcccgttcagctgtctgatctgttgcctgagccctcggattttcttttccagatactgtttttgttgtttctccgaaagtgtcagaagatacttgatttccttcagatcaagccccattgcccgatacaccagaatctcccagagacgttccagtgtagcatcatcatacagtcgataattgtctttcgaccgctgggcaggcaatagtccttcatcatcataaaactgcaaagttctcttgcttactcctgccagccggctcacttcgtttacttttttcattacggcctttacctttccccgtacttttcagcataaactatcacgcatacgtgaccgcaatactgatttccagaaatgccatttcttggttgcataaagacctttgaaaattttgcgaggtaatatttccggaaataaaaaagttctggaaaacatctgtttcccagaactttttatcctttattattcatttttcttacaaacctgccggatcagctgaatcagtgccaccactgccaatgctatatacccgtaatcatcacaagaaaacccgtctttcttcttaaaagcccagattttcatccaccagaataatctgaaaccgtcctttgaccctgctgaatcgggttgtcagaatctgacagcagatgcactgtggacttttacagtcaaaacagcttccgtttttggaacatggtgtgtcaatgccaaatcgctgtgcattaatcggtgccgcctcattccgcgcacggtgcagggcatcctcttccgattttacaaccttattcatacccacaatcagcaggacatgctttggtccataggcatacgcagccacacgattggcattcccgtcaatattgataaacacgccatcctcgctcatggcattgacactgcccaaaaaataatccgagctgaatgctttccgcgcaatctcctctttttcctccggggtttttactttatcccggtcataaaattcataatcaccgttggaaacggcatcgtagagaccacactcctttacagaagttgcaccgcccatgttgatactgctgcccttcgggatcaattcgagtgctttctttacggcctcttcttttgtctctacataatatgcttccatgttgcgggaattaagtgcctccacaacacgcgctcccagcttttcatttctcatttttcttacatccattgtgtaaacctcttttccaaatagctacgctatgatttcatactgcatcagttcatatttgagtctgcttccctccataatttccggtggaagcagtgcccgtgccacaagtttcagatcatcactttcaatatctgtcctctttaaatttgcataatcgccgtcaatactgacaacttcataataccatgtttccatatgtcacctccatttttaatctcacaggctgcttaacggtgctacatgaatatgatgttttacatatttgttgatcccctgtaccagtccgtccacaagtttttgcaatttcctgtcgctatgatccgaacactggttgcccagttcaatatcaacggaaggaattgtactgtacgaagtctgcgtcagatcaatctccgtagcaccggttccgtttattttaatcttttgggaacgcagccctttgatcagtgattttcccaatgcgtcatgttcttcccagtaagatgcaaccggacgcatttttttgagtttttcgggaacagaagcataaaagcatcctttgtcgtaagaaagtccatcgctgtcccaatgcagcgcaatatgacaatccgctacattgttacatatgacggtacgcgccacgttatccagctgtacatcctttccatcccggaccatgagcacatcatacccctctgccagcagtttctttttcagaatccgtgccatacgaagcgtcacatcacgttctgccgttccgtcccgaaatgccattccatctgaaaccgccactgctttcacagagcctgccgctgtcgttcctccggtcacctttgcagagccatccggatgacacagcgtttttaccgatgaaccgcctttcgtcccatgtcccgcattgactgcaatcacaatgtccttccggttctttttcgccttgtacataacggcatagcccgatgtaattctggcatgatccgcatatttccaggaagagtccagataaattttctccttccccttcgcatatccgcatatcgggaaactgatgaccatcaaaaatacaattagaaatactatcccctttttcatatacactcctctttctaaacattcgacagtttttatccccctgtaggagcaaaatatcttttcactgtctttactctacctcattttttatggtaacacaagataaaatccccgtgtcgttgcatttcggtgcctttaagagtatcattaccatgatacgaattttaggaggataaatttatgaaattaaaaacaagacaaatcactgttacagcaattttactcgcaatctgcattgtaagccagtttttcaaaaacctgaatgtatacatcacaggcccgatcatcaatgccgctctgattttaaccacggtatacgctggtctggcctgtggcatcattttaagcgtgatcactccaatcacttcctttttcatcaccggaagcccgattatggcagccattcctgcaatgttcccatgcattatgattggaaatatcattctcgttctggcagttgccctgctccgcagtaaattcggtaaaaaagccggtttgcccgtatccattgtaattggcgctgtattaaaggctctgtttatgggaattttgatttctcttatcattctgccgaatatgctcccggcaaaaatgcagccaatgttacatgtcctgcagcttcaattttctgtcacacagttaattaccgctctgatcggcggggtatatgctatcatcattcttgcggtactgcgtaatacctctcttggtgagcaggcgtaatcccacattacataaattaacgccccggcagctacaactaccggggcgttttatgtacctctccaaagtaccagttctttttattttctttgtttactctacatttttcaaagcctgatccatcggaatcttcttgattctctggaaatcaaataccataacaatcagatatccgatcagcacaaatccaaacatttttgcataaccaatcggtgttacgcgaaaagcgaaccagccgctgtaggaaaagagcatcatccgccatgccgcggccataacaagtgttccaagaatcacactgatgagatccgcgattacaaccacaatactcgtcgaaagcagatacagactcgcgatctctttgttttcgtatccaaggatttttgtcatggaaatcgcattttcattcttctcaataatcagtttcgtcagaagatagatcataaccgcagccagaagaatacaaagaatctggaaataattcatgtacgatcccatcgaatggtcaagctgatctgccatctttgtaatatctcttatcgtaatggtcgttgcaatattttcctcatcaatatctgtaatcctgctgtcggataaaaatccactgaattcattttcctttaagtcaaatacttttccgtaattgtcaatcgacataaagagcgcaagactttgggacttgtcataaaatcccgcaactttaaacttgtaagatttgttttcatacttttcatccagcgatacggtatcgccaacggtaagtccatacttgtcagcaaacgaagtggaaatataaacttcatttttcttgagcgaacttaactttttgatctttacatagttgctggtgtccgcgattccatataccgagatctcctcatcaagcacatcactcttttttacgagtgaggtcatgtcaaacttctccgcatctttattttctgtcgtaatcagtttattatcgtcatcctcataggatttgagcacatactggtattttgcaaacatcatgccatccgtattgctcttgtaataatcgagcgtatccggcataccgaccgccatcgcaagcatgatcatgataaagaaaataccgacaaacaagatcagatagtttgcaacattctggaacatgatacgcagacggaaacggcttaaaaagctccatctcggcagacgcatggcttttttgttctttgccttttttaaatcatgacgtaaaaactgcagtggtgtatgctgcatcatgcgcacgatcacaatcaggttgacaaccagcatcaggatcaccggaaccaccgtggtcttaaagaatgcatccggattccagatcgtgtaatacgttggcagactgtaactgttgtaatacatcgacacaacaatatttttaaacaccgtatagccgagtatatttccgacaatcgcagccagcagtgttacaataaccggcatggacagatagtgctgcaccagctctcttttcgtgtaaccggacgcgcgcagtgttccgatcgcggaggactcttttgcaatcgtattgctgatcgtcacggcaaagataaatgcgatgattaccacaaggatatccagcagcacaccgcccatggctttgtccgatcccatatcatcggttgcaaaattgatcgccggatttccgtatttcggtgtgtaatcttcgagctcattgtccgcaacaaccacctgtgtgagcaatgcacgcataaaattatcagagcgtgttttttccccggcctcatccgcaggctccgtttcatatttccatgcataagtatagtgaatgctcttgtgcagccggtcgaaaccgtcctgtgtcaccattgccacatcaaatttcagtgcatcaaacatcagatctgtggtcttttcatgtaaggtggagtaattgacatacgcaagcagtcccacaaccttataagtctctccggaaactgtgacggtatctcccacctttattccgacgttgtcggcgtgcatacggtcaatggcaatttcatccgccttctgtggaaaacttccctgcagcatacatgccaggttgatatcctttgtctttgcaaatacgcgaatcgttccatcctttttcccgtcgttattataatcttcttcctcatttcggaaaaagttttcatacaatgttgtctttgttgccttaaaatccgctttttcaccggtctcaattgccgaaagcaaggtggcatctgcctgtttttttagttcaaaatgaccgtcttcctgtttgtattttgtcacgccttcgtttgccgaagtaatcatactctcgtttgccacatacataccggacacaaagccgatcgtgagcacaagaaacaggaatacaaccagatattttttccaatccccgatcagttccttcggtattctcctgatcaggggatttttgatttttttctttttcatagcagcccccttaccattccagatcttccgcggataccttgtttgtattgatgtcgttgtggcgcaccgcaccgtcacggagcttgatcacatggtctgccatatttttgatcgcctcgttatgtgtaaccataatgatggtatttccgtattttttgttgacctcctcaatcagctttaagatctccttggaggtattgtagtcaagtgctcccgttggctcatcgcagagcaggatatccggattttttacaattgcacggccgatggaaacacgctgctgctggcctccggacaactggttcggcagtttgtagcggtgctcgtaaagtccgagcgtatgtaacagatcgtcaatatcaagcgcattgtctgacagatacgctcccacttcgatgttttccttcacgtttagatttccaatcagattgtacatctggaatacatagccgagatgctttctgcggtactgtgtcagctttttctcactcatatcctctaacttatcgccgttgatattgatgtaaccggaatcggcgttatcaatgcctccgatgatattgagcagtgtggattttccggaaccggatggtcctaacaacacacagaactccccttttgcaacggaaaaattcatgccgcgcaggacttcctgacgcgtctgtccgcttccgaatcctttctttaaatctacaatttccaaaaacttcttttcttcttctgacatagaaactccctttccttttggttttacttttcatactaatattagttttatctaacctctggttctttttttaggtctcccgcaaaaagcgaaagacctgtgcttcttttctgaaccttttgtccaaacgcggacgatctgtgcttcttttcccgaccttccgtcaaaacatgcggacagcctacggtctgacgagtccgtaccagcctgccagcagatattttacacctttttccgcaaaccgcagtgcttcttcctcgtcatcaatgtgcgttaccataaatataaacatatcgatctgtgaatgggacatccagtgtacaacgctttgttccaccatcggcacatggtaagctttgcacatcgcttcacagataaatgcattgtgctcatccatctggtcgaccaaccggtccggcatacgttccatacttgatccctgcgcttttgtcagcactaaaagcacttcatcccggtaggtgtacagttcatggacaacctgtgcgactgcttcaaaatcgctgctgtcatcatgctcttttgccttgccgctctccatctccctgacttcaaaagaaaaatgctcccgcagaatttcattgagccgatccataaaatttcctaccacctcacagaacagatcgtccttgtcctgaaagaaaaaatacagtgcccctgtggtcacacccgccttctggcagattccgcggagagacgcccccacaaaccctttttccataaattcttttttggcacattggatcaggtgtatcttcgtctcgctgtcatgtattttctttcctgccatggtacgctccctgtaaataaaaatgtaacataacgttgttatgttagataacaccgttatgttacatcattcccatgtctatgtcaatagaaaaacttatgcatttttctgtttgtgtttatcataagctgcaaacatgccggcaagcaatgttccggaaatagaatgccaggtgcaggaaactgcgcagatgatcgcagactccggtgttgcggaaaactgtgcggtcgttgtggcaaggtttgttgccagtcccgcattctgcatgccaacttcgatggcaatggttctctttttggcggtattcatgccaacaagttttcctgctccataaccaagcagataaccaagtccattgtgaagaaaaacagctacaaagattacagctccggactggaagaacttcgcgccctgggaagataccacaccgccgacaacacacgccagccccagtactgccacacccggcataattttctgtaactcactgaacattttctttttccccagcagatagtttaaaaggaagcccagtgctaccggaagaataaccgtttccacaatggaaacaagcattggcagtgccttgatggaaatattggttccgcttgccagaagagaaaccataagtggtgtcatgatcggggaaagaatcgtggatacggttgtcattcctacggaaaatgccacatctccaccacagagatacgacatgatattggatgacacaccacccggacaacaacctaccagaatgagtcccagtgcaatgccggcaggaagatgcagcactttcgtcagtgcgaatgccagaaacggcataatcagatactgtgccagtgcaccaacacagatatcgaatggtctctgtgccagaatcttaaaatcctgcgttgtcagtgtcagacccatactgaacataataataccgatgatgattgactgacttgtaaacttattggaaaccggatcggtaaataactgatggtttacccatcccatcattcccggaacgataaatgttactaccgcaattgcaattaccacaattgatgtgtagtccgataaccatttgctgagtttttgtagtgctttcataaacttttcctccttggtctgttcactgaaaaacgaattcagacattaaaaaagccccttcccagatactactctggaaagggacgaataaaatccgcgttaccaccctgattccacagaaaaactctgtgacacttcacataccaacatatgctatcccataacggaggaaaccggcaaagtttactcacagttgtctgctttcagcccgcttcttagagaggatcatccatatccggctactacctgttcgcaccacccacaggctctctgaaaataacgataagatacgatgctgttctcatcaacgaatttcggtgaacaatattttcttttcgatgattattatattcccctgtacagatatgtcaaggaaaattttttccaccaacgcttttctgattgacctctccgtttgcccttatgggacatacattacatctttttctctatatgtccccacaactttccatcagtctttttcaaaatgctgataatccttcgaatgtgtccaatcgccgccccaggtaaatccatatctggtaaaaagcttgtaacacagatcatcgtgatcaatcttgtgcggaaaattcccactccggtcaacatatgcttctgcgtttgcaggctcaatcgacagctttccgttgacggtttttacatatgggttataaagcgtattgatatcaactgccatgcccagaccgtgttttgagatttttgtcgtgtgggaaatgaaacggaaattaaacgcagaggaattgttatcgctcatggatgcctcatcatccgcatcgtattcatccaccagccggactttttcaatgggatattctgcctcatacaactgcctgaaaatggcaaggacatcctctgcaatggctttatttaccacaagttctccctcttttgtctgaccgtcaaaccccatgtggagcacatgaagatagcggagatcttcccgcggtacggtacagtctgccttgtatgattttccctgcatcttctcaaaaatatcgtccgggattttggaaatatagaacgcttcctctgtgatacttttcccggtacggtccgcattttcaacactttgttctttctgcgtatgatccggttcgttcatgttttgttttttctcactcagttctgtccctgaagtcctgtgatcctgttctttttcactgttctcctgatccgcaacctcagacttttttgtgtttgatttttccggatgccggatcagacggcttccggttacgactgcggcggctgcaagtaacacggccgcagtgatgatcattcctttttgttttttcaccagtttctccttactgacacgtttcccttttctgtaaacataaaaattcatccgcttcaacatgataacaccgctaagcctacgctatcgaaaaaagtgtcatgtgaaagcccgaaggccgcatttctgcacggatgaattgtgtatattttagcactgatttttgggatttgctatattttcataacaaaaaatgcatttttcttttaatgcaccctcgaaaaataatccatcagaattcccttaatatgattataccttctggcataagaattttccacccgtataatctccatattgtgtgcctgacagatggcatttttcttccggtcgcgctcctgcaccaccgcatcctcaaaatgctctttcccgtcaagttcgattgccagaaccggcagttccttttttccctgtttttcgtacacaacaaaatcaaagcgccccatataaaacagatcatcatatgtcatgttgtcctgaaacacctgcgatatggcaacttctttgtggatcacatacttactctgggaaagccagatattttcgagcgcatgcgtcaggttttcgagaaatgcattttcggtagcggtagaaaacggctggatgccaagtgcacgggaactgatatgtttttccgtaatctctgacttcccgttggttttgatgtactgcgcaagttcataaagatcatcgtctgcctgtcctgcatgcaggcgctccagttctttgctgtctgcgagcagaacaagcttgtctttcgcccgtgaggttgcaacattgatcagttccttattgtttttcagccattgataggtaccgacattggtgcggtcggacagtgccgtggaaaaaagcaccacatccttttcatctccctgaaaagcatgcaccgttccacagactaaattttcgaggtggttttctttgatcgcctgctcgatcagtgcccgctggtttacaaacggtgtgatcaccgcgatacttttgtccgtgttctgcttcgcgtatgcaatgacctcgtctgcttccgccggagatgtatttttgatctcggcacggtcactttttacatctacatagacaagtggctccggctctttgctttttgaacagatctgcagtttggaattgtaatattttttattgttaaatccaataatttctctgttgcagcggtaatggctgcgcaaaagcacttcatcactcaccgcatcacatgccagatacgttttgtaaatcgaattctttctgtaatcatattcctctgccacatgataccgccgtcgcagcttgcggttgatcagttctccgagcagaataaccggattcagctgctgcggatctcccacaagcatcagtttctctccacggataatcgggacaagagagatcgcaacattgcactggctggcctcgtccataatggtcatgtcaaacagcggctctggttccccaatcttatgtgccgatatgcaggtagtgataatgattggaaaaacacgctgcagcttttttacattttcggatttctgcatgtatttgttgaatgcccgcgcctgtgtctctggattttctccggaatctaaaatctcccgcagttcctgatatttgggttcttcgagtgtcttgatataacgcgcagacgtataaaataaatactgataaaattcttcttcgttgcggtcgagaagctgcagggcatccgaatcagaaatttcgccaatctgatggattctctgatcgagcttctgcatctggtatccctgcagatccatctgaaacgggagcaggttcatggcatttttgatatgttcctgatattccatcagatgcgaaagtgtctctttccgctcctttaaatccagaatttcctcatactctttcagtctcgcagaaagacgttttgcacggtcaacccggtcatccttgcgcttatcgagcgtggacgtatatatttttacggtctgcacctgatttcgcaggcggttgatgtagctgatcgcagctttaactttgtctatattcccaagccgcagtaccggaaacggaatggtctgtgcatggtactcaagatgtgtcagtttttcaaacacattgtcgattggaacgttattgtaggacgcaaataaaacggtcgtattgttaaaaaacgccgttactatcgtgttgatgatcgtatttgtttttcccgtacccggtggcccctgtatgtaggcaagcggatatttcatggcgttgttgattgccagcagctgatccagattgatgttctgattgatcagtgcaatcggatacgccttggtgcggcgcggccgttctaataattccccaaagaaggctttgactggataagtaacctgctgcttttcaaacatatcaagtatggctttgtactcgtcatgcagattcagcactacatccatcccaagccccagcacatacggcatatcatctacgaccggcttttgcccgccatgaccggtaatcgcatctttgattttttccagattgttttcaaaatcttccagcagttcgtactcgtccgcatccagaaatttacgcgcattttccgtctgtccgtcaatgccaaactgtgtgcagactgtgatatcttcatccggctgaaacactctgtttttcacatcaaggttcaggttccggtatgccagaacatacagccccttcgccgtgtgaatactcaatacattgagtgccagtttcttaattcttaaattggtgctctttttcttttcgtgagacagggaatactggaaatttgacacgacctcctgaaactgctgatcgttaagtgcataccgtccgtttttcacacgatccccatcgatataatggatcagatcataatcggtgatgtaaggtgtcgtatccatgcggttacacagttccagataatttagtattttcagatttgcagagctggaaaaaatagttttataacgctccggatgcatctcgatatcttcgatcagctgcctgttttccggacagtacgttccttcaatgacttccgtggacaggatggaatccacaaaaattttgtcatattcccccagtgtatacattccgaggtgcagaccatctactttgagggtacgttttgccggatcaagatcacggattccaatccagtattttgtaatctgatccgctttgttccgatattcgattttcagccactttccctcatgaatcgcccggaaaatgtccctgcaaatctgattcatactatgctccgtcctgttttacatgatatctctatcattcattatgatgttcggacagaacctttgtcaagcaaatcctcaattccccttgctgctcaaaggattacttctcgtttcaaaaaactgattgttatctatgcgtgcgcggtttttgtcgttgtacatactgctctgccggattgcgtcattttctttttcctgttccggtgtgttctcctcaaaatgttttggtcctgcggtaaccggatctgcatccgttcctacaagcatcgctgatttatccgtgtaattttttgttttcatgacatacctccatattttttgttagtatgtccgatttttatcctctccactcccgtaagtaaaagtttgtaaaaacttccgtaaccggtctgtcttcggattctcgaaaaattctttcttaaatcttcttctaatggaatatcgtactctttctcaattcgtccgacatcgtttccagatgactttttactgttcttgcaatgatttcatcatcttccacgataaaaatgcgatacattgatttagtatctgccacgcaaccgctgctgttcgccttcttctcctgatgcagaaaaagataatcagcacagcaataatcaccaaataacttcccattgcctgtcctcctgcgtttccatcatgaaatcttatttcctgcctttaagtggtacatgaactttggaacaatatgaaggacagtatagatccgctatgtatgcagcagtgaaagcccaccgggaacatcacccaacgagtctgttcccgacctcacggtcagatacatatgaatagttgtgtttatcctgctaacactaatggtatatccattgactccataacaaaatttgtgtataattttgttatggaatgaggaggtgtttttatgccagcaatcaaatcaagtgctgatttaaggaataattacaatgaaatttctacattttgtcataattatcctgaaccagttttcatcacaaagaatggaaaaggcgaccttgccgtcatgagcattgaaacctacgaagaactgaccagccgctttgaactttacagccagatcaaggaaggaatggacgatattgccacaggcaacaccagaccattttccgaagctatggctgatatcaggagccgccgcaaccgatgagctatcaggttcatatcacttccaccgcagaacacgatattatgcgtgctgcggattacatccaatttaccctcagaaatcccgatgctgcagataatctgttagatgctgcgactgaacagataggctcactagccgacctgccacagaagttttgtctggtagatgatccggtactggcaagctggggcattcgttttgcgataatcaataattaccttgccttttatacgattgatgaagaaaagcagactgtaatcatagtccgatttctctatcagaaaagtaactggacttccattcttcgacagggattttccctcatttaaggaatctgtttttatgcaggttcctttttagtgcatattatgtaattgctcttgcgcatctattacatctacctgaatccgtgaaccttgtttcaaaatgaaaaggcacacaggaaatgtttgccatatttgttatcgtacactaaattttgaaaatgctgcccatatcggtcaatggttctttccatgatctcataaattgtgcgtattccgacagttttctcctcgttatcagaaagggaatatgtcacatcccggaaggtctgtccgatataaacagctttcccatcacgtggatgctggatattctggcagcattccctgacggatcccagccattcttctttactttcctgtctgggattccgttttatgatgaaagacacattgttgtattatctttctggtctggtccataaacccagtacatcctcattgcgccactggttttattttccagatatgattgcctcactttcattccataacgtctggataatggctctatttcatgggtttgaagactcggataacccggatcagccgacaacagctttaaagcctttccccattttttatacaactgttcttccttcttttttatattaccggaacgatatttctcctgcagatctaaccaaagttcctgcatttcaggaattcccattcgtatattaaaattcatctcttattccttttaaaaatctgacaggtcaatagcccgggaaacatcgcctctcttaaagttacttactgcacgatccatatctgccagagttctggctgaaatgctctctggcactgccagttcccgaggttccagaataatgcagccatttccgtattctttgacattataatactgataagcagctcctctgagcgtaattctttttttgttatccagatgggcaacataatcttttattgcttccattaccaacacctccctatcaaacttaaatttatcgatttctttattatctaatctgttagtaatctatccaacagcatctgcctattatttataaacatttctgttacctggtaactctctgtatcctcatattcgcacagatgtatgcgtccattatcaaaacaatagatatctgcatctggtattcctaacaaaattggcgaatgcgtaactatgataaactgtgctccctcttttgcacatctgtatatttgcatcaacaatgtaagctgtctctgcggcgataatgcagcttccggctcgtcaaaaagatacaagccatttggattcatattattctgtgctaatgcgagaaaactctctccatgtgatttttcatgatatttagcggaaggatgtgtaatatctgcatattcttcttcctgcgttgcaacattataaaagctttctgccctaagaaaatatccccacttttccttccgatagcctttggcaattcttatcgcatcacacaactctgaatgtgtatcatgcgtagaaaaaacataattcttcgttccaccctcaggattaaaaccatgtgctacggcaagtgcttccaataaagttgatttaccgctgccattttcccctacaaaaaaagtaattggtttgttaaaatcaagtttttcaactcccttaaaagccctgattcccttcagataactatccttatcaattttatcccaatcaaatattactccttgtatgaattgatcattcacctaatcacctccttgtaaaaaacactttctaatccccatcttcttgccctttagacaagaagcattcttcaccttcagttcggtcaatctcgatttgcattcccattcattttaatagagctttgcacctgctggaatgtggtcatcaaccatctcagttcctgcttcttggtcaaatggttatagaactgcaccacatcagaatacttaatctctgctatatttcgctttccaagtgtatcccggataaaccggtcatacatataaagataattgctcttggtcgttggtttcagattgtttttgagactcatgtagcggtcaaatacaaaatttactgtagcctttccggcaacataaatatccagaccgtccatctgatctttcatgatctgtgcttctttttcccgaagtgttacaaggtcttgtgcataaacatatttacgtcttccgatagtatccgtataagtatatacatatctctcgtctgaacgtctctgtgattcacctttccgcagaactctgccccgcagatcttttcttgtctgtgccatattcagttttattctacaaatccgacagtgaaattcggtcgtaagcgccatttttcttatcttccggatgtggctccagtccgataattgtaatatctttctggtctggtccataaacccagtacattctcattgcgtcactggttttattttccagatatgattgtctcactttcattccataacgtctggataatggctctatttcatgggtttgaagactcggataacccggatcagccgacaacagctttaaagcctttccccattttttatacaactgttcttccttcttttttatattaccggaacgatatttctcctgcagatctaaccaaatttcctgcatttcaggaattcccattcgtatattaaaattcatctcttattccttttaaaaatctgacaggtcaatagccggggaaacatcgcctctcttaaagttatttactgcacgatccatatctgccagagttctggctgaaatgctctctggcactgccagttcccgaggttccagaataatgcagccattttcgtattctttcacattgtaatactgataagcagctcctctgagcgtaattctttttttgttatccagatgggcaacataatctttcattgcttccattaccaacacctcctacgcaagcatttgtgtgggaaatcccacctcttattataatacgcttttctatattatctgtcaatctacctttacttactcctgatacttgaaaaatggtatcgcccatgccatcctccgcagtcttataaattacattgaatggttcgatatcttccattgtctctatcttatgggtctgaagataattgatgaattttgcaaactcttgtaagttggagagattcttccctctccgtttcatctccgcatagaaatttgggagcagtggtctgccctgcgttttcttatcataataatcttgcaagctttccaaaagtgtcggattctgcctgcgatccagttcggctttcatttcctcatacgctgtcttcatccactgaacggattctttcagagaaataaacatctggttgaactgccggatagctcggttcagttccccaatcactgttttaattccccttttcgccattgcccggacttcatacccttcatggatcgtcggaatcagatcaattctctgctctttgtaagagcggtgatcaattcttgctgccatgtgacattcccagaatttttcgttcactttctctgtccacgctcttctccattcctttaaaagttgtctgtaagttcctgtactttttgtttctctgtttgattatctgccatagattacctccatttttgcatgacaaaaggcagcccacaatggactgccctaataaaagaaaaagtagcaaatcgtttaaaaccataattttcataaaaagaaagcaatagaggtgcgcaagacacccctattccctaaacctcttgcaaaatctgcaatagtggtttataatcaggttagaaaccgaaggatattagcgtgtccaacggttgcacaatcggaaacttataaagcgttaagtttattaacagattacaggctatcctctattgcgagtagaggatagcctttccgtttatttgcggttatgtttattgtctatgtatgtcaaggctgcaaatacaaccaataaaagcgtaagcacttctaaagtatccataccgacctcctttccgtctccagaaaggacaaccgcaagactatccctacttgctctaatctgactgaaaatattatatcatttcgtgtcgaataataccagcaccacttacgatatttcctctgccggttccaataccccccggcaaattcctcatcgctcatgttctggagctttcctaacacctgctctgcaagctcctccatatcgctgtcctttatgtgaggcattacccgtctgatgtcctccatcagctctgtcttgccctgcctgtcaaatacacacatcacctgctcttaatacatcctctttcaatacctgatatcttggacgattaaaattctttccagtctgctggtcagtaaatatcttttctagttccagattgttctgctcacaataggctgtaatctccttgatacctctgtctaaatgctgttctcttgtacttgttctgtgataaccatatctcttcattattattcgctcctttccttagtcctgaaatgtacactttttgaaactacaaaaaaaggactgctaaacagtcccgaaatgtatggacatccttttacggaacgtcccagtatttatgtatgctttttgaaaccatctccttaaaaatggatataaaaaaagaaggtgtatttcaaccttccattaatcgaaatattttattttgaattaagatacttctcatattggttcttaaccatatcaggaaacatagtaaatgaatctcctgtactaatcatcataacatcgtaattcccagtttccttattagttatttcaaccattcggtaatgatgttcttcattattaacccttgtaatttttgaactttcactgtcatcctttgctctataaaaatattcctgtccatttagtttaaattgaccatcataattctgcatcctcaaattctcctttattattaaaatctttgttctatatgtaattaagccccatcagacagatttctctatccaatggggcttctatgtcatatcgtctgattccacatcattatattattttcttacatcaaactctgcatcgtttggcgtaaaattggcgtatttttgtaattttacaaatttccaccaataaggtacatcacgtttttagtaaagctttgcacctgctggaatatggttatcaaccataagaaggtgaagttcttcatcctctgaatccttaagattgtttactgctgaaagtaacataccgcaagattcaattcccatcatctttcttggtggaagattagttatagcaataagtgtctttccaacaagctcttctggctcataataagcgtggattccgcttaaaatagtgcggtctgtgcctgttccgtcatctaaagtaaactgtaataatttctttgacttaggaactgctacacactcttttaccttaacagctctgaaatctgacttactgaatgtatcgaagtctacttcttcctcaaataaaggttcaatctttacattagagaaatcaatcttctccggctcagcttttacctcttctgaagacttagaacttacaccattttcagcctttacgccaccaatgctcttcattgtcgggaacagcagtacatcacggatagcctgactgtctgtcagtaacattaccagacggtcaattccgtatccgataccacctgtaggcggcataccaatctccagtgcgttcaggaaatcttcatcggtgtgttctgcttcgtcatcaccggctgcggcattggcatcctgtgcagcgaaacgctcacgctgatcaatcggatcatttaactcggagtatgcgttacacatctcccatgtattgcagaataattcgaaacgctctacctttgtaggatcgcttggtttcttcttggtcagtggagaaatctcgatcgggtgatccatgataaaggtcggctggatcagttccttctcgcagtattcctcgaagaagaggttgatgatatcacccttcttgtgacgctcttcgtatgcaatatgatgctcgtcagcaagcttctttgctgctgcatcatccggtacctgatcgaaatcaattccggtatatttcttgatcgcatcgttcattgtcagacgtgcgaatggctttccaagatcaatttctacaccattgtaagagatcttggtagatccgcatactttttcagcgaggtaacggaacatggattcggtcagttccatcataccctcgtaatcagtgtatgcctgatacagctccatcagggtaaattccggattgtggcgagtatccacaccctcgttacggaatacacgaccgatctcgtatacacgctcaagaccaccaacgatcagtctctttaagtaaagttccagggaaatacgaagctttacatcctcatttaatgcattgtaatgtgtctcaaatggtcttgctgccgcaccacctgcgtttgcaacaagcatcggagtctctacttccatgaaatcacggtctgctaagaagttacggatctcctttaaaatcttggagcgctttacaaatacttccttgctctcctgattcatgatcagatcgatatatctctgacggtaacgcatatccgtgtcggtcagtccatggaatttctctggaagaatctgtaaagacttagaaagcagagtcatctcctccgcatggatggagatttctcctgtctttgtgcggaatgcgtatcccttaacaccccagatatctccgatatcggatttcttgaaggttgcatacagatcttctccgattgcgtcacgcgcaacatagatctggatgcttcccttgagatcctgaatatttgcgaaagatgcttttcccatgacgcgcttgaacatcatacgtcctgcgatggatacgtggaccggatcggcatccatgatgcttcttctctcctcataatctgctttgactgcctctcttgcagctgcctcgtccataccatcggtattaactgccggtctgccggctaaaagtttctcttcgtgtgcattgtaaagttccttcacatctgatgtgtgatgggttacgtcatatttggtaatctgaaacggatcctgtcccgcttcctgcagatttgcaagcttttcacggcgcacctttaacagctggttgacatcctgctgctgtccgccctgctttccgttattctgtcctgccattttcatttcctctcttaatctacggttgatctctggatctcgagtaccttgtaagataactctccagcctgtgtctctacggtaatggtatcgcctacttttttacctaacagtgcgcggcctaccggtgattcattactgatctttccctttaagctgtttgcctctgtggaaccaacaattttgtactctaactcatcgttgaactcgcagtcgagaatctttaccttacatccgatgctgatcttctccagatcgacctcttcctcaacaacgacttcggcattctttaagatcttttcgatctcctcgatacgcgcctcgatgtctctctgctcgtcctttgctgcatcgtattctgcgttctcggacaagtcaccctgctcacgggcttctttgatcttctgagcaacttccttacgctttacaactttgagattctgcagttcgtcttcgagctttttcagaccttcataggtcaagatatttttcttatccatttgatttacccctgattctatattttttatatgcagctttttgaaaaaagcgcataaataatccacaataacctaggtattatagcgaattgtccacattctgtcaagatattctccttcaaaccggactgtcgctcatccgtgaagttaccgcccgccccacaccgtgtccgcccagcaacctgaacagcaattccgtgaacatcgacacagctttctatgcatcagacgaaatactccatcaatagtgtctccagctgttcgtaattttccacctgattgattgccacacgcagccgtgctccatgcggatatccggcggtataccatgccgcatgcttgcggatctcacggataccgatatattcacctttaaactccagcatcatccgggcatgacgcagaatcatctgtgccacctccgatgccggcggcttctgcagatgctctcccgtttcaaaataatgcaggatctgccggaaaatccacggatttccctgtgccccccttgcaatcatgaagccatcacatccggtctgttcttccatggcaatcacatcctccgccgtaagcagatctccgtttccgatgaccggaatctttacggcttcttttacctgacggataatgtcccagtctgccttgccggaatagaactgctccctggtccgtccatgcacggcaactgctgccgcaccggaggcttccgcaatctttgccatctccaccgcattgatatgatcatcatcaaaccctttgcggatttttaccgtaaccggttttttgatcgcttttaccgtcttttcaatgatctcgcctgcaagttttggatttttcatgagtgccgagccttccccattgttgacaatctttggcaccgggcagcccatattcaggtcaagaatatcaaatgggcgatcctcaatctgatgtgcaatctcagcaataatatccggatctgatccaaacaactgcaaagacaccgggttttcccgcggatcaatcgtcagaagtgcctgtgtattacggtttttatagagaattgctttggcacttaccatttccatgcacagaagccctgccccctgctctttgcacaacaagcgaaatggcaggtcggttacgcctgccataggagctaatattaaattgtttggcagtgtcacactgccgatctgaagtggtctgatcataactattttattttccgattctgttttttatacacaagattgatcccttttaacgtcaggttcggatcgtaaatatccacagcatccgtctcattggcaatgatgcggccaagtcctccggttacaacggttttgatattttcgagtccgacttccgctttcacgcggttaataatatattcggtctgtccgatctgtccgtacacaagccctgcctgcatacttgtgatcgtgtcttttccgagaattgatgccggctttttgatctcgatctccggaagttttgcagcatcttcccacaaggcttttgccgaaatccggattccgggtgctgtgatccctccctgaaaggctccgctttcatccacataatcataggttgtggcggtaccgaaatcaatgacaagcaccggacctccgtatatttcgtatgccccgactgcatccacaatacggtcagctccgatctgctgcggattcggtgtcacgatgcggattcccgttttgatgcccgcctccaccacgatcggtgtgatatggaaatatttgacaagtccgcccctcagggaatgcatcacattcggcacaacggaacagatgatggcatccttaatttctgtcggatgaatatcgttctgctccagcagattcaaaagcatcatgccgtactcatccgatgtccgtggcatttttgtcgtaatacgaaaacttgcggcgatctcatcgccctgaaacaccccgcaggtaatattcgtatttccaacatctatggttaatatcatttgtcttcctcctcgtccagtgcctctaagccctcgcccagatacagaactttgtaatacatctcaagtgcttccagcaattcccttttttcgttgcgcagctgcttgattttcagcacgcttccgatctcatcatagcagaaatcgccttcttcgcaggaagtgcgaagttccagatttcccgcttcatcaaataccagctccaatactccgccgatatcctcggtgtaaatgacgcacatgatttttaactcgtcacggatggactgtggaagtccattgaagttctcattcagataaaattttttctggtatgcgttggatacgcacaatactacctcatttgactctttagacatatccatagattcctctcacggagacttctccggaagacaccagttttcttgactcccaggtgtctacgatcagttctcccttttttgtaattcccatagcctttccctcaaatggctccttcgggtccaacacacgcacctgccggccacggttcacaagcagctgatcgtactcttcctgtaatgctgacagatcctcggtttgcagatagatcgcatacagccgttcaaattcttccagaaatgcctcaatcagatctgcacggtgcacacgttttccgcactccagcagcagggaacctgcatgatcctgcagttcttccgggaagctttcattgtgcacattaattccgattccgatcactatatgattgatatagtcaaactgtgcactcatttccgtaagaataccacagatcttcttaccatttatgacaatatcattcggccatttgatcaaagcctctgctcccgtcacccggtgcattgcatttgccactgccatcgctgtcacgagggtcagcatggatgcatggttcggattgatgtccggtttgagcatgagtgtcatataaattcccgttcccggaagggaatcccatgaccgtccgcgacgtccttttcccgcagtctgctggtccgctaccacaaaagttccggacggatgtccttcttctgccagttcttttgctttcgtattcgtggaatcaatcttgtcaaaataatacgtttccgcgcctgcccattcggtctttcggatgcttgccagctccacttcgtccatacggtccggcacagataccagatgatatcccttattctgcaccgcctcaatctcataaccggcctctttcagctggttaattgccttccagacagcggtccgggatacgccaaactgattgcacagctcctgaccggacacatatccgtccgtctcacggagcagtcttaaaatttctgctttcataatcatactttccattcacaaaaatatgtaaacgttttttcttagtcagataacgttgccttcatgatcgccttgatggaatgcatacggttctcagcttcatcgaagacaacggagcgctcactttcaaatacctcatcggtcacttccagctcggataatccaaacttttcataaacctgttttccgatcgtggtctttaaatcatggaatgccggcagacaatgcatgaagatcgcgctgtcctttgcatttttgaatgcatcggcattgacctgatacggtttcaggtcattgatacgctctgcccatacttcttccggttcacccatggatacccatacatctgtataaatgacatcagcatccctggttgcttccgcaacactgtctgtcagtgtgatggttgctcctgtcgtggaggccacgtccacacaataatccactagcttcttgtccggataatattttggattggtgcaggcaacaaaatgcataccaagctttgcacaggtaaccatcagggaattgcccatattgtaacgggcatcccccatgtatacaaacttcacacccttaagttttccaagatgctccttgatggtaagcatatcggcaatcatctgtgtcggatgggattcattggtcagtccgttccacaccggaacccctgcatattttgccagttcttccacgatttcctgtccgtatccacgatattcgattccatcaaacatacgtcccagaacacgggccgtatccggaatactttccttttttccaatctgggaaccgctcggatcaagatatgtcacatgcatacccagatcatgtgcggctacctcgaaagagcatcgggttcttgtacttgtcttctcgaaaatcagtgcaatattttttccaaccagactgtcatgcatgattccctgatgtttcttctctttcagctctgcggacagatccacaagatacaggatctcctccggtgtaaaatccatcatttttaacaaattacgtccctttaatgtcattgctcttcctccttaagtgtacgttgaaaacattttactccatttgccggaattttacaacaatggtatggaaaattgaccgatcaaaaaaggagctctgcctttcgacaaagctcctggatttttaagtttaataaaatacaatcggtcctacaaccgttcccgcatgaccgctggatgccagtttgaagtattttgccccacctgtcggatcactgccgtttaatgcggctctcgctgcctgtctggcgcttgcgctgaccccgctggcaagtcttgcttcaagtctgccggaagatgccggtccaaactgacctctctgatagataactccgtagatagaatttgcaaatccgccgcttctgacacgattaacaacaaccgctccaaccgctgtcatacactgtacgctggttcctccggcctcacactgtacaagtgctgccagaagtgtctcttcatctgcacttgcggcaatcgacgcattctgtgttgtccgggaagatgccgactgaccggacgacgatttcttttcagcagaaacagaagcattcttctttgcttcttccgctgcctttttctcttctgcagccttgattgctgcctgttcttcctcaatagtgactgctttgcctgtatccagtgtgacggtcacataatcttcactcacataacaggtatctgaaccaactttgacggcaatccatccgtctgtttcttcggcttttgtattcacatccatgtgctcacccgatgcaacggttttcactacctccgcatctgtgtcgggtgctttacgaatacgaagaccgtcaatggaaaccttcgcaaccgtatcacagtgtttctttgcataatttaatgcatctgttcctgtcacacaatactcattctttacatatcctgttacattgccggactcaatctttgtccaggtatcgcctgcttctttcacaactgcgcgatcccctttgtacatctttccgacaatttcggaatcagaatctgccttttcgcggacgtaaagaaaatcatccaccttcgccatcagcttattctgccactcctgttcctcttcggaaacagtttccttttccgtggtttcttcacttgtatcatttccggatataaccgttccatctgctgttgccgcaaccaaagccgcatttgtcttttcaacagaaatatatctgtccagatagtctgccgactccaattcatattcattcatggcagatgccactccggcaatcccgttattgacaaactgtgtgtctgctgcatcctttgctgcaatattcactccattaccggtaactgcagtgaccgccagtgtgagtgccagtcccgacacgattacactttccatcacctttttgcttgctttcattgatgaacctccgtagtttgtttcatccaccttttacccgtggattcgtaacattttatgcaataagtattacacttatgttgcgtttttaaacactttatttcatttgttacaagtttgttacgtggcttattgtagcacaggaatttccatttgtcaaattttagtataaaaatgggtggtggtctccacttttgctcatattccgtttaaaaaatgggtgtgcgttttcactgcacacccatgccggttttgaaaatgttacatattttatattcctgtgtcaatttatgtattgtttttgataaaaaacattccactatgggaaaatttcctgcaaaacagttgaaattatgcggttttcttcctcatcctcatgtaaatttttattttgcactttctccggtgatacacttttttcttcctttttcccaggcttgtccatgtgtttttttaagtacaattccaggcgtcttctgcaccggtttgcttttttctgttgccgcacaatacaaaacaccccaattgttaaaaataaaaaaagtatgatctgcaaccccataatcattaactccatttcattttgccacctgctgatccacatcagtattgtcatatctgctcccatcctttcatattatataaaatcatttcttactgtataaatcttattataatgaaagaacgtcatcaccggaatatcctttcggtcgcaagtttcgacatatgtcgttactgctcatgttgcttgacatttctatatggatcatatagagttgacttaagtaaagaaaagaggaaatatcgaatggctaaatcaaagaaaattgttatgaccggtggcggaactgccggacatgttactccaaacattgcccttatgccggcacttcaggaagccggttatgaaattacatatatcggttcctataacggaatggaaaaagaacttatcgaagcgcaaaaaatcccttatatcggaatttcttctggaaaacttcgccgctattttgattggaaaaacttttccgatccttttaaagtattaaaaggatatgggcaggcaatctccatcctgcgcaaactcaaaccggacgttgtcttttccaaaggtggatttgtgtctgttccggttgtccttgccgcaaagcactgccatattccggcaattatccacgaatccgatatcacaccgggacttgcaaacaaaatcgcaatccgcggtgcaaaaaaagtatgctgtaatttcccggagaccatgaaataccttccagcggaaaaagcagttcttaccggttcaccgatccgccgggaactgttccacggagatgccgaaaaatctcttcactactgcggtttcccggatcacaacaaaccagtactcctgatcgtcggcggaagttcaggttccaaggtcatcaatgaagcggtacggaaagtgcttccggaactgttagagcagttttatatcattcatctttgcggaaaaggaaatctcgatgagaaattaaaaggcgtgattggctatgcgcagtttgaatatgcaagtgcagaactgaccgacatgtttgccctggcagatcttgccatttcccgcgcaggtgcaaattccatctgtgaacttcttgcattgcacaaaccaaacatcctgattccgctttctgctgctgccagccgtggtgatcagattttaaatgcgaaatcttttgctaaacagggattttcttatgtgattgaagaagaaaaactgacggatcagacattacttgatgcagtacgcgaagtatatgccgaccgtgaaaaatacatccgtaccatgtcagagagcggtcagatggattccatcggaacgatattaaaactgattgaaagtgtttctaaataattcacacgccaaaacaaaaaacatgcatatctgctgtacgtttttccagcgatatgcatgtttttgtatatagagatacagattttttacatcttcatcttatcacagatttctttcatctcatcatcggaaagagataaatgctcccactcaggaactgcctgatctcctgctttacgcggaatcagatgcatatggaaatgaaatacggtctgtcctgctgcttctccgttattctgaagcacattgtaaccgtcacatcccaacacttctttttcgtgtgtaataactttctttgcaagctttgcagcctttgcgagtacttcatcatcaatctcaaacatatttgcatagtgctgtttcggcagaatcagcgcatgtccctttgctgcaggacttgcatccagaatcacacggaaatccgcatcttcgtagatcgtattggtcggaatatctccgtttgccagtttacaaaaaatacaattgtcatctctcatttttttgcctcctaaaatacaaatatctgatcgagcatacgaagcgttttaaaattccctttcgctgtcatctcacccgtcataaacgctctctggaatgtcatccgtccgtcaatgattgactgcagaacatctctgcttaattttgcaaccacgtcaatcttttcttcctgaccgtaatgaatctccaattctccgttttcaattgctacatacaatggctttttgattccttcgataataaaggaatagctggcagcaaaatcctcagtagatacaaaatgactttccagttctttcacaaacggtgtatccatatcatcatccggttttccaagcatatctttgaacatcgatgccagttcctcaatatcctctttctgctgcttcacataagtatcatccgatacatacttcgagagctgctcgctctcctgtggtgtcagattcagctgctgcgtccgcagaacactctgctttactgcctgattactggtcggaagatttttgatcttctgggaaatggtccggtacaggttttccgctttcttttcaatgatcagcgtataatctttattctgcttgaattccaccagatcctctacatatccgcataaccctgcacatggtaatccacccagaatctcccatgcattcatcagagtcagttctccctcgcgctctccataggttgtggacataacaatcggctgcatataggtatggctgattttttccttatcaccatataaccagcaggcatccagaaactgctgcatataaccaccgattcccagccactcaatcgttgtggcaagaataattccgtctgcctctttgaacgtcagcggaagggttgcaatttcattcttatgctcatatatattgaatcgttcgatgtttacccgaagttcccgtaaaacatcttccatcttttttaatacatacagtgtcgggtcatccaaaagtccccggcctccataatacacgttgattttcatcggtatactctccttgctttgatactaattagtatagggattttcccccgataaatcaactgctttacgaggtttccggtataaaataattgcaagaacaaatcccattgcaaggccaccgatgtgtgcccagttgtccacatccacgctggtaattccataatacaggctgatcacaatcataaaaagcagccctttgcccgtaagagattcatatcttcctttgtgtatcatcacaatccacagcaatgccccgataataccgaaaatagcaccggatgcccctgccgatacctcatgctttccccatgcggtcatttgcacataggacagtgtacttcctcccacaccggcgatcagatacagacacaggtatttgatatgtcctatcgctttctccagaatcggaccggcacagatcagtaccagcatattattcaaaatatgttcaaatccaaaatgcataaaagtagctgtaaacagtctccagtattctccctgcttcacatatggcggccagaccgcccccattcttaccataaactccgaattttctgtatttccaaggatttccagaatcacataaacaagaacattcacagcgacaaatcccacggttacaaatggaagtttctttttttgtggcatacttttccctcctgattttttcacatgctatcagtatactcacttccatttggaaagacaaggcagttagcaaaaacgatatcggacatccgcgaaacggatcatgtcattactgtttaattttcttctctctttgtaagccagcggctcatcattcacaaacgtaccatttgtcgaatttaaatcttcaatataatagatctctccatcatgatcaatccgcgcatgcagctgactaatcgtatctgcctgtatttgtatgtccgcatcgggaccgtacccgattcttgtcattttctttgtaacacagatatcctcgtaagattcagctccctgatacaacaacattcccctgactttccctgtcatgctgttcaggcataccgttggccgatattcgggttgtgccactgtttttattacttcctccggatatacaaccgcagacttcgcaagttttctggtatcctgcaggcattccctacttccatgataagattcatatacctgtttttcggtttcttcctcttccagaagacctatttctatcagtagcttttttaattttctgatccactccttctgctcctttttctttccctcctttttcttttccccctttttctttctgttggctctttttacagtttcatcttttctttttttgtctggatgatcttcatattttctttcaggaactacgggttgattgttttcctctctccaaactttttccattccattttccccggattcctccacggccgcctttttcccctcattttgtctggatcttacaatttcatcccggatatctgtaatagaataaccatccagaagcgtcttctcataaattccatatgcagcctttaccgcctgtgtatctttatgatccacctttgtaagcagaaattccatcaactgctgaaattctgtctcaatggttccactcccacccggatatacggtaaaaataatttcctggttgctgttggtaataaatattaactcgggatccagcatcaggcaattggtctgaatcagattccattccagaatctccatctcactgcaaatgctcataatcagtttttcaatgaaagaaatatctacttcttttaccctgcaatacatatcaagcgactgtttgccggatatgttataccagtactgtccctccccatccatatatgccttttccactgcaagaagtcccggcaattttctccgcagcatcagcttttcatccagccccgcatggattcccgccgcaattttcataaaacttcccgtaagatttctttcatatattatttcccgattgatcattttttcacctcttttaaaatctgatactgataaaaggaatctaccgcccacatatcttccatctgcttttcttcatgctccccacgtacttcattcaataaatcaattcctgtacacatagctgctgccatcgtccatatcagaacaggtatgatcacagccgcttctacggtataacttcctctccatttcatattttctccttttatctctgtattccccacatgaccaaatgtgcccctagcagaaacggcacaaacggaaactcggattttctgtttttatgtccgaataccagcaaaccaagagccgtaattcccgcaatggtaatggcaatcatgacaattgccatcatttcacccaatgcataaaaacaccccatgcataagattaccagaccatccccatatccaatactttctcttgtactccaggccagtataagcataaatatccccggcaataatcccaaaaaccataccggatttttccaacagccccccagcagtgatatggtcatgcctgatattcccagaagcaaaattgcccagccatgaagttgctgttttctcatatcttcccaggagagtcctgccaatccaaacgtcaatatgcacattctgatcatttcatagttattctgcatgattttacctcacctccgtattcgcaccacatttaccacaggctctttttcctcccgtctcttccaaaaggatcagataaatagttctttttagcccactgcaggcaagatcactatgataacaggttccataatccgtcacatacacctttccggcaacatgattttttgccacgcacccggaacatgcgctgtacttatgttcatttttgtttctcatactgctgatctgtgcataatccgtacttttaatactcaaatccagataatggcactttctgctcctgtgataaacagttccatgttttgtaacatacacataatcactctgctttccatctgtacggtcgccaatccacttatggctcttacttttctgacagataccaacaccctttacctcaaaaaagctaattggaattttaatgtaataattaacctgcaaattaatataatttcctgacagatcggattttgccatcgtaatcgcatgttttccaccgcgaatatatttttccggcaaactgtacgttcccagctcctttctaaaatacgcttccgcagataccagaagccccgtttgcgatgaaacggcagatgcttcacatgctgtttttctgcttgcataattcaatgcctcctgaacttctgtctgaatctgcaacacccgaaagaaaaataggagcgtaaggaaaaacacggctgctacaggaataatcacggctgcttccagcgtatacgatcccttaaaaaaggaacataaggatgccttttggcaaggatgttctcccaggttatagatatcgtcttgcggattcgaatctattggttcgtttattatcttatgaatacatgcctgcttcggaaaaggttgatatttgagggtaattgttggtttccactgtccaaaagacatccttacatcccctccttcccatgaaaataactatatccggaatgattttgaatccggaatccatttgagaaattttcaaggatggatacaaagccaagaaataccggttggaattcataggtggcagtaagctcagtttcacacaaaacgtggtccatctgaaaattttcgtacccttcctgtgtctgtacatacgcttcctccacatccatggtgcgcattgcaagggtatttcccttatgaaacaaaagcaaaatggcagcatattgtccataatccaatccctgagaacaatctttcgccacagaccagcccgacaaaagttccggaatcatatgtacatttgaagtccagtccgcatcactttttatcattgtaattttcccaccggacaatagtgtccttacatctaacacactttctgcaaatgcccacgctactaagattccgtattttacagcttcgattacggccggatttgcggatactcccgccaacgtgaccgcaagtgccattgcctctgattgtcgctgggaagatgcggttaatgaggccatatttaacggttctctcattgccagcagctccgtaaccacaatttttaaattatccgcgtcatttctttttccgcccagaacatactccagctcatattccaatacgcgatcctgctgtttctccacgtagtttccaagataattcaccagatactgataaaacaatactttttgataccagtctgttcccacataagaatccatcgtacctttttccagacttctgtgtgaaacagtttcttctatattaataaattttccggatacctttgtattttccggcaaaacaagggatagtaccccttctttttttacttctgtcaccgtttctaaaggattctctgttggcgttgccttttccccagaatcctctttctttgttttatccccctgacgcgcttccccttttaactgccgggatgatgaattacctgccccctccgtttcatatttttccggatgcttcagtgcatccattgcatctgcaataccctcatccggatttttgtagtccttttttacttcttttattgcttcataatgattgtagacggactttgccatctcgtaggcaatattctttttcatataagtacacacagccttctgaaatacgacaccattctgatctgtcagcaatcgataggggtcataccttgcatctgtcatctccgcggtcaacagactcatcccggaaagcaaagttttttgttctttgcttccaagatgatccgatgtaaggccacgcaactgtgcttccctgttattaaaacataatttaccttttgtatcttccacccgtactccaaggattttgtaagtttcccacaaaggactgcaataatcggcaaaaacggattccaaaaccgtatccgtattcatatacaatactttctgaagttcataatgtctcgctgcttctaaaagtgtaaaaagaagctgcgccaccagcatcagtgaaagggctgcaaacacagtaatactcgcctttctcctcactatacctcccctgtgcgttctttaatcgtgttgaaaatatcagaaaccagcgttgtcagttttttcttgaacaacacaacaattcctatcagcaccacaacgatcaacaccatttctacaactcctaccccatcttcttccatcaaaaagtttttaaatcctaacataatttttcctccttatacttgaaatgacagcattgccggaatcataatgatggcaatcacgatgccaagcatcatcatgagtggcaacagcattttcgttcctgcctcttctcccaatttacaggccagtgctttcctttcttccagtgcattctccgattcctgttccaaaagtttacataatcccctgcttccggtctgtaaattctgtaaaagaatccgaatgagtctctgatactctcccaaatccactctttctccaaatttctggtatgcaagacgttcactttccccgtccaggatttcgtgattcgttattatcatttcttcatagatataccgttcttttatttgttttttctgccttttatcagagtattgagcggaaattctattccatgcctgttttaatgacatgcctgctcccagtaaaatcagaagtttacttacaacttccgcataatccagtttcatctgctctttttttatatgatctgcagtacgttttctctccagaacaattcccgccatcaggaaacagacaagcacctcaaaaaacaaaattttccataccagatgctgttttttttctttccattgcagcttcacccctgccgcctgatccggcagcgtcagatacctctccccttcctgcgtactctgctgctctacttcagctgcaatttcatgaatgaccttttcctgctgcgacatcactttcgggtatacttgaaaagaaaacgtatattcctcccggtacttttcacaggtaagtgccacactcgcctgtacaagttctccctggggatctaattgatcctcccggatcgttccatccacgtccactgcattgtattgatccaatgtccagtcggcttttaccaatcctttcacatagcttggcttcatatgcacctgctctgttacatgtgcagcctcttctccctctgggaaaaaggtttcgtctatttccttttctgcccgggaaaaataggattgtgctgtcttttcatcaatacattgtgcaggaacgcttacctgatagtcataatttttcagtttctcccctgcattcagcgtaagttccacttcctgccgcccactgcccggactgccccggataattctgtttttatcgtccatactgcgatcggaaaattccatatatgccccaagcagcaataacagaatacaaacaaccgctgcttctattatttttttccttctcacacttccccctctacatatgtattgtcattattttctctgccagtacaatcgccccaccataagctgcaaggcatactgtcataaacaatgcccctgccacatttccatataaaacattcaggaaatccatggatgtcaccttcagatataacaaaatgaacaacggtatcacattcattactttctgttccatctttctagaagcaatctgtacctgaatctccctctctgtttcatggcgcacccgcatgtgccgggatgttgcatcaataattgtcacaaaatttccaccgctgcgttttgcaaatgaaaaaacttcagaaaaacttgcaatatccatatttccacttcgggttgagaaatctcccagcagcagctccaatggttgattgaggctgatggaacaattcatctcctttacctcctgatacatataggatcttttcccatataatgcgagtatttctttttctgcctctttccacgcattttctatagagaaaccagcaagtaaagccgcactgatactccggagagtatccacaaattccttcgcaagctgtaattgcatctgctcttcccctgcttttttctgacgcttcatgaaaaaccagataaaaacaggaaaaaatactatccccagccagctggcataaaataaatacgcaattgccactgtcagcagccccgccaaagtaatgcttttacaaacttccttccggctcagatgatacacacgataatccatcttctatctctcccttctcccgggcaagtcctgccatctccagttttttacgattctttaatatgccacagtgcttccacttccagctgccctcggttccttccagctgataaatcggagaaatctgaatctcgccattttccactccgcatacctctgtaatttccaataccctgcggcttttatctggcaatcttcccaaatgaacaatcaggtctatcccggatgcaatctgttgtctgattgcagcaatcggcagttccattcccatcagtaccatcatttccagacgggagagaatatctctgcttgaatttccatgggcggtggataatccgccatcatgcccagtgttcaatgcctgaagcatatcaaatgcctccgctccacggcactccccaacgagtattctgtccggacgcatacgcaatgctgtgcgtatcagatcccggattgttaccggctggacgccctccatatttgcattccgtgtttctaaacgtaccagatttttgattccctgtatttgaagttccgcggaatcctcaatcgttataactctctcatcctccgggatatactgtgataaagcatttaaaaatgtcgttttcccggagcttgtccctcccgaaatcaacaggttgtattttgcccttaccagcatctttaaaaactctgctgcatcttccggaagtgcccctttttgaataagggtctgcatatccagcggtttctccggaaatttccggattgtgattgtagaaccatccagagaaaccggtgccaggacaatatttacacgggagccatctgcaagtcttgtatctacgattggattcgataaattaaccacccggttatgtcttccaacgatctgctgtatcacatcctgcattttttcttcgctggcaaatgcctgattccatgcatgaacccttcctgccttttcgtaaaaaatatgtttcggtccatttaccatgatctcggaaatttccggatcatccagaagttcctgcaaagcatccagttttctgagtgaattaaatactcttgcttccagcatcagacgttcccgaatggaaatgggttcctcctgcatcagccgggatgcctcttccccaatcagattttcaatttcttcatccgacatctcccgcgaaagatccatgcgttccaatacacgttgccggatacatcctacatactcatccaaccggcatcatcctccggatactgtctccaaattcgttccatttccattgctcgacgagccgctcgcaggacaccacaggggttgccacagatggaagctgtatctcccgcagattctcggataaccgttcttctccgcgtttttgaatttctgtcaaaaattctttctctctccactgtccaagccctcctctgcttttcatcaggaaaattttctggcagctccccagcaattcaaaaaatcccataaaccgtgaccccagatttaaaacgatggttgtataattcatttcctgcgctaaaatctgaaacaatttctgatacgtcagatttttcacttcacacagacactcggtatttcccagaggatacacaacatctgtcctgtccagatgaccgatgcaggaaaccatcctgctctttgagtattttccgctttctgccatcaccagaagttcttccatcccggacgaataaaattcccccatcagctgcgacaatccactgttttcctgcaaatccagaagcaaaactttttcgttttcactcagaatggaggacagcgtgaccgcaaacggaagctgcatttcattttctgccagcgaatatactgcaagaacctgtaatttttgcttcacacccccactggcattttttatttcctccccaatctgttttaaaatctcatcgacgattttattcacttcctgatacttatccacaaacaccacccctttttccacctctttatccacattttcatttccatcaaacagataaatttgtggaatttcacattctatcctgttttccccagccaaatcatccgacagaacaattgcatccagggttttccagttctcctgaagtgcctccttcttggaaaacatgtgcagctcaagctgatcccgataatgattcatcaggcagctggtaaaacggtcaccatactcccggtctccaatacagagtcccaatcgagctctcctcatagctcctcctttcttttcaaaacagtgacagccatactgtccgatgcgcatataacattcccagtaaaaccgcaacagaaaaatgcatcagattctgctcctgaacccagccatttcgataagaggagaatttccccgaaaacagttccctaaaaaaaacctgtgctttaaaaaggctgattctaagattgcgcatatacaacatcttgagcacggctattactgctcctgccacaaatgctgccagcacacagtctgtcaatgtttttaaattagtaaatccaccgataacggaaaaaagtttgatatctccggcgcccaacacacctatgagataaaaaagatataacatgataaccggaatagaaatattcaaaagaacttgaatgattcgcggcattccacccaaaactataccgaatgccatcgataaaaataaacccatgataatcagccggttactaatcctcatgctggtaatatcctgaacgactgccacaattaggattgcatacagtgtcagaaccgatgccccctgcatcgaaatcaatttgcatcacccctttgttgtgaatcgaattataacaatgccaattttatttgtcaagcagttttttacaaattttttgtataacttttccatttttgcttatacttgtaaaagagagacttcagaaagcaggtgatccaatgaaattgtttaagacaacccctcagccccctgacggctatgcaatacttctcgataatctgaaacagacaaccgcagaactgcaaaatacctatgccaatcttgaaaatgtcgttgatccggatttgatcgactattacatttatcaggcaaaagccgtacagatgcgctataaatttcttctgggatgtgtaaaaaaaatagagggaaactattcgcttccctcctgaccgttcacattttacggaaattttatacaaaaaagccccggtgacggtccacatccatataatcttcgtttacggcaccgcgcgcataagtcatccctgcatatacctgctgggtatttttcataaggggtgcactcttgtcctgtttcgccacctctacaaaagaagtatacaaccggtgcatgatatgttccgcttcctgcactccatccagccgattctcgtacatcgcccgtgaaagctcatttttacagaacatatagagtttatacaggttgtgcgagatcggatacgaaaaattgagacttccgatcagttcatccagaacactctgtgcattccggatcgcatccttctgtccatcatgatctcccttgcagtgtgcctgccgaatatcatccacataggcaaaaaagatatcgtaaatgatgacgatcatctcaccggaattacactggctcagtcgtctcgtaaaatcttttttcagctcattttccatatgctactcctatttctgcagcaaagacagtacctgctgtggaatatcatttgcctgtgataacaccgaaacagcagcctgttccagaatattctgctgtgtatattctgtcatttcagatgccatatcggtatccataagccctgaatacgcggttgtcatatcttcctgtgtctctgcaagactggagcttgcatactcgagacgattggtatatgcaccgattccggagcggacagcacttaattttgcaattgctgcatccatcgtgctgatggctttgtcagcacctccgttgaccgccacatttaccgtatccagatacagactctccgaggaaacttccggaatatgtacatccatattctgatactggttcgcaccgatctggatggtcatcgcaccaacatccgtcacatcaaatttaagggtatccccattttgtacgtcatcactcagcagaaaatccatggaaaatccacctttatccgtgattttcacacgatttccctcaacatttgtaattactgtacttccaaattcgtttccaagtgtgacctttgcgtccgatccacttgctataagtttgtaactttcgtcatcagcattctgaacaactccctgtgcttttgacagacctgttttttgtgccatctcttttgacataccaatggtcagtgtctcctttgatcccttgttatccgcagtaatattataaactcctgccttatttggatctttttcaaacttgcacccgatctcatctgccacggacatcagctgcttgtatacatcatccgcactcatgcccttttcatactctattcctactccattgatggaaaccgtacccccgtcaaaattcggatcattgatcaggttggacatatccaatgtataagtagcttcctttgccacttcatctactgtaatcgtataatctcccggaagaacctcctcggaaaagtcaattcttgttgcgctccgtgcaaattttgtagtatccttatgtgttccactcacatacacacgtgtatttgccgaaccgtcaagcaacgtcttcttgttgtactctgtatctgtggaaatccggtcaacttcctgtgtcagctgatcaatctcgtcctgaatactctgacggtccgaataagagtttgttccatttgccgcctgaacactcagttcacggatacgctgcagcatattgctgacttcgtttaatgccccgtctgcaattctgagtacggactgtccatcatcagaattcgcttctgcctgattcagaccatcaatctgtgctttcatcttgctggagattgccattcccgccggattatctccagctttattgatcttatatccgctggaaagacgccccatagaaaggctcagtttattttctgtccgaagcagctgccgattggctacaacagcagacatattgcgattaattttcatatttattccttcccgtatacgctacgtttgagcatccctgccctctgatttgacgctccctgtcatttcatctgacatatatatcgtccgaaaatgtcaattctttaataaaaaaaagtataatttgcaattaacgggaaatcgtattataatagcaacattaaacgatatttgcaaaggaggatttatcccatggctaaagtaaccaaggatactatgatcggagaacttcttcagattgatgagaacgtagcacctatgcttttaaacattggtatgcattgtcttggctgcccatcatcccagatggagactattgctgaggcagctatggttcatggaatcgacccggatgatctggtaaatgatatcaacgatttcatcgagcatgatgcaaccgcatagatttcacgtatcaaaaaggagtgctgaatttcagcactcctttttgatttaaattttctaaagagatgcaaacacctgcagtgcctgcggtcccgtaattttatttccatgctccgcaaaatatgctccgactgcaggattatagtttttctgctgtgcatattcgcaaataatattgcagactttattaaactcttccggtgtgtggtcatctttgtggatcaccagataaaaccggtttttcttctcgttcttaaacaggtcatttcgtccattgtaataatttacaagtacatgtgcgagacgctccacctgatctatcgtcgtaaattcaaacattttcgtcagatctgccggtacttccggtacttcttccggtgcctctgtctgctgtgcattttcactctccggagaggcttttgcttcacgtattttctggaaaagttccaaaatatcatctgcgcctttgcgttccacatttccgactgctcccgtatttgaaaacagttcctcatctccggcttccgtaaactgggaaaaacgggtatcgagttcttccgggtattcaacctttgtaatcagcaaaaccagggattcggaagacaatggaattgcctctaccataagtggattgtcactcacatcaaatccaaactcataatttgcctgctgtatcatatcatggaaaagtccttttgctttctcagaaccatatgccagttcccgcagattaatctgacgatctgcaagatcctgttttgttaatgtgcatcgaatctgattttcatttactttttcaattttcatctctatcacatccttctctggaaatcgctttccgtaaatggtacacttattataatcaaatgccctcccgttgtaaagttaccacggattaaaaaattataaaaaaaatacttgcattgcaaaataaagtgtgttataagtttatgcatgagatgcgtctctgacccaaaggagcgtatgaataacaaaaatttaatattgtctgaccgatacgagttgattcgtccccttggccagggagaatgcggaagtgtctttcttgtcagacagcaatctttagagcagtaccgtgcaatgaagcgattccccaaaaatacttcggcacaaccgctcttcgcaatatccgaagcacagattctaaagtctgttcagcatcccggaattcccacaatttatgattttgaagaagatgaatcattctactatcttgtggaagaatatattcagggtgactctttagaagaatttttgcttcatcaacagtcaatatcccagaaccagtttttatatttttgtgagcagctttgtgacatttttgcatatctgcatacattacggccttctccgattctttatcaggatcttaagccggaacatattatagtatgtggaacacagcttaaattgattgacttcagtgtcgcatcttttgctgccatttctggaaaagacttcaaccatttcggaaacgtggatttttctgctccggaacttatctcaggaaaaccggtaaccctgagatccgatatctacagcattggaaaaatcatggaatatatgatgccatatctggatgcagccaccaaccgatccatttatcccaaaattcaaaaagcaatttcagcagatcccgacctgcgatatgaatcaccgcaggctctgtactctgcattaaaagaagtaattgaaactacgggaagaacgcatctcaggcagacaattgcagtcgttggaagtcacagcggctgtggtgcaacacacatagcaatcgcgctggtgacaacacttaactaccttggcatttcggcggtttatcaggaaaaaaactggtcaaacgatctgcgcaagacggttgcccagttgaaacatgtgtgggaaaaaaacggttgtttcttttatcgcaattttacaggatttccaaaatatgacagtggcatcgaaatcccagagcctgtcgcacaaatcatggtaaatgattacggatgtgatttttctttctcctgccttgcaacggcggatcatattatctatgtgtgtggaggagcattgtggcatcgggacgatgcaaagtccaaagactttcttttacaaaattttggtaaccgcctgcatgttgttgcgaatctgtgcgaccacaattctgccatttattttgccagaacattttcacagccggtctattcttatccgtttaacacggacatctttcgtgcagacaaagaaaagctggattttgttcactggctgcaacaacctgagaaaggacggaatcgcctatttttacgtttcataaaccatttattccggctcctgcaaccataggagtctgcggtacaacagtaaattccggtgtaacacactttagtatttcgctttgcaactttttacacagcagatttctggcccgcaccgcatacctggaagtcaattccagtcatgaaatcgctgcgctttcttcgaaaaaggacccaaccattccttttcgctgcaatggtgtcagctactatccggagattacactccggcagctgcgggaacagttacatctgcaacacaagtataaaattctggatttcggggttctgactccatactcatttccggaatttgtccgctgtgattactgtattgtactgacaaatgtgagtatttggaaggatcggcagctcttgcaatttattgaggaactgaaaaaaacaaatttaggaaaggattataaaacaaatgtccgttttatgagtatgggaaacctcaaaaaagaccgaaaaagagtcgaaacgtcctatggaatccgtgtgattccggttccctttctcgaaaacccgtttcaagtgtcctctcatgattttggattctttgaacaaatatggaaaggaaaacagttatcacattaaatttatctactgacaatcagctggtcattgaattcagaccagaagtatatgaaagtctgatcgttactttttaaaacgatccattaaaaaaaaataaaataacaaatgggctattattatgggtgtgaaatgagtctcaatgcaactccgtcacgcacaaaataaactgaaaaaagacaaatgggagggcagatccacagacacaactgccctcccgaaaaaattcaaacaacttctatttcttaattttatctgattccatttgaatctgtacaggcacaatgctataatcggaataaatatataatttgccaacagacaaaggaaggacggctcatgaagaaaaaatctcattccattttcgctgtgcttgcactggcacttgtcattgctgcagcgatcgtagtcttcgccctgatccgcaaatacacaccgagtaaggaacacgaagatttaaccacttattatcatctgacaaattccgatgaggttgccattgttttaaataatgaagtaacctcttccaaagccagggtcattgacggtcatatttatatcgattatgattttgtccatgacaatttaaattcacgtttttactgggacaataacgagaatatccttctctatgcaacaacacaaaatctgatctcggcacaggcagagcagaccagttatatggttacaaaatcttccgcagattacggtcgtaaaattgttaccataaactctgatactgcatatattgatctggattttgtgaaggaatattccgattttaaatacaaacatgtaaaagatccccaccggatcattattaccagccagtggggaaaataccagactgccactgccaaaaaaaatgcctccctgcgcgtaagaggaggcatcaaaagcccgattctgaaaaaagtttcttccaaagaggaagtcaccgtgatcgaacagggcgacaactgggacaaagtaatgacagacgacggtattattggatacatgcagaaacgtatgctttcctccgtcaaagaaaagacaagaaaaagcgatttcactccggatacctttgcacatataaagaaagattacaatatctgtatggcctggcatcaggtcacaaaccagtctgcaaataacgcggtttcctctgtccttgccaataccagaggaatcaatgtactctctcctacctggttttatctgaatgacaacaatggaaacattgccaacctggcaagcctgaattatgtaaattactgtcataaccaggggattgaagtctgggcgcttgtcagcaatctggaaaataaaaatgtcgatacaacagaagtcctgacccatacctctaagagacagaatctggtaaaccagattgtttctatggcgattcaatacaatctggatggaatcaacgtagactttgaaagtatgaatggggagaaagtcggggatgcatttattgaattcatccgggagctttccattaagtgcaaaaacaacggggttgttctttctgtagacaattacgttccgatgtcacatacttccttttataaccgaaaagaacaggcaaattttgcagattatgttgtaattatggggtacgatgagcattatgccggaagccccgaagccgggtctgtcgcctctttaagctgggtaacccagggtgtaagcgatactttaaaagaggttcctgccgatcaggtaattcttggaatgccgttttatacgcgtgtatgggaaatcccgtccgagagcagttccgatgacacagcagccggtgccaaaattccctcaaaaatttatggcatgaaagctgcaaccgattttctcgccacacatggtgcaaccaaaacatggcaggatgactgtggacagaactattcggaatttacagataatgacaccacctataaggtatggctggaagactccgcctccgcagaatgccggttgaaactggtagaagaaaagaagcttgccggtgcatccttctggaaactcggatttgaaacgagtgatatctgggataccgttaccaggtatatccactgacttacctgcatatatataggaataaataattccataaagcaggttctatgaaaaagaaatttgaaattcttatggttgcctgtctgtttataagtgctttcttacttgcgcgtgcatcagctgcactgacatcttccagacatgcggcttcctccaaaacctgtatcgttcttgatgccggacatggaggaagcgatcctggaaaagttggctgtaacgatgctctggaaaaagacatcaacctgtctattgtgctaaaactcaaaaccctgtttgaaaacaaaggatataaggttgtactcacgcgaagtgatgataccgttcctgcagatgaaaactcgcgcagtgtaaaagtagaagatctgcgaaaccgcgtaaaactgatcacagataccaatccggttatgaccatcagcatccatcagaacagttttccggatgccgccgtctccggtccacaggtgttttacttcaaacagtctgtggaaagttctgcaattgcctcagtaatgcaggataccctaaacaacagccttaatcctccaaagccaagggtttgtaaatccaacaacgactactacatattaaaaaaaacacccacaccgatcataattgtcgaatgtgggtttctgagcaatgaaacggaagcagctctgctggtcacagatgcttatcaggaaaaactggcgcgagccgtttaccttggtgccataacctatctggaaagcggaaaagacgtaccggatactgccacctaatccgtttctttacgaaacgatatactagttacacttgatctcaaactctttatcctgtgcaaactgtgcactgttgtaaagaatcagtatatcggtaggtgaaaacatttccaaaagccggtctccgcttacattcagctggcgaagatccacaacgacaagtttttcataatcttctgccagaaaaggaaggatactgttcgcaaaagaatccttgatcaaaagcagcgtttttccgttctttattcccccggtaatctcaagcactgcctgattcccaccggtaaaaacgctgtactgatctgctgttttcagaaaagaaaaatcgtacagtgtctttgtcttcttttctcccatattataaacaacacgcagtttatccgccggctcataaatctcaattttgtctgcctgtctggcataatttatttttgcataggttgttccatagaaatctttactgatgcaacggaacttctttttcccctgtgccctctgaagatctccaccaaccgcctttgtgtattgttcataggcataccatgctcccagcgtcgtccagtgatggtctgtccggtaatagatttcttcctctttatgtgcatccagtacgggctccacggaaatcagtacatcctctttttccaatttctgctgcaatgcatcataaaacttctgctccttataatgaggggcaaatgccggaagtttttcccggagtacccacgactttgtcggcaccatcatcacatggacatccgcgttctgttttgtttttccgacaaacttctccagagcctgcagatttttggaaatctgctgcggatcaaactctttttctgtatagtgttccaaaaggtaatggttctttccgatgtaaacattatgaatttcatttttgcccataaacaattccatgtctgtctggaacgaaacccaatgatcccttccgggaaactgatcccgcagatacgattcatattttttctggaatcttccatccagaactttcgttatacttatttccgggcgtgtctgaagttctcttttttcaaccggagaataggttctctgatgcgacagtgcttcttttcctgccaggccgaggagaagcaccataaaaatcacccccggcagccgtttgaatatccgtatcataattttctctatttgtacagtttattgatggcttttacggccttttcattctgctttttatatgcagcaatcactttgtcctcggactgttcctcctgcttgttgctgattgttccaagcatgataaagcatacatagtttccttttacataaactttggaagcctgaatctttaactggttcatcgggtactgacaggtatcctgtatcagttcctccctgtatttttttaatgccgaccggattttctttttggaagctgcattctttgcttttacaataaccagtgtgtctgcatttgcactgatcatcggcacctccgcaattgcagcactgtaccatttggaagaaattccgtagcgttccttcaattctttctttgatactttttcacttgggatataatcatccccatacgctttctttacagcattgtatactttttgtatggatggggttttcttccctttctgcgtggatgcttctaccgtcaccggtgcttcccatgcattttccggtgcatatattcctgtcacacaggcaagcaccagtatcattgccacaattttctttttcattcgccattctccttccagatcctgtatattttcattcttatcgtgaaaccacctataatctggtttccgcactatcctactacagatcttttgtttttgtcaaaagggattttatggaattaataaaaacttccgctgtatgatacaaccgcgttgtctgtacctgattggaacggtctttctccagttctccctgctctttcatttcactttccctccggattccggacatctcaaactgcgacaaagaaagatccggtgtatatgcaacatggatatctgccggttcctgcatggcatcctgcagttcctgcaggtgttcttcgatctgttttgcggtctcttcctcgcttgtcacaattgttccagaaatacggtctgattttacctgaaaagatgccgtaatctttcctgccttttctccatccagaaaaatatccacaagaccctttttcttttttcctcttacgatttttaaagaaaccccggtgacagaatctcctgtctgcatcggaatcacataacattcttcctgcgattgtttcgcaccaatctgaaactgtgcggtcatctggcgcatttcccggatatcaatcgtgcggacatccggatcttctacgatcatcgtatccatcacatgctctgccacatccgcaagcgtctccatggcatctgcaagatccgaaggattctcaagggcttttgaaaactgttcaagtacctgctctttcatctctgcaatctctgtcatggaatctttggaaacatgatcttgctgaaacaaccgctccatcatccggtttggtttgcgcagcatttccgatgctgccatgacatttatcatactgtttggaatatcataccgctccagataggtatatacgtcttccggtgtttctgcaagctgctgatactgcgcaagctgttcctgccgatagcttttttccgcttcctgttccccaacggattcatccatctgccggagtgcctctgccagttgttccggagacatattctgccacttttcttctcccagacgggaaagtttttccggtgaaatatgttccatcacatcgcgcagacaattctgctggaacgcagccgagatctgctcgtcaattttcgaaccttctgctgtgctgtcaactccgtcaaaatcatcgtccacctgataatccagaccactctttttttctgaacgcacagcacgcaaaaggtttcgcatcgtcacgtccgatccctgattcatcagaaatccaagtgctgccccatctcctttttccacctgtgcgatcagacggtaaataccgatataactgctgcgctcttcctcagaaatctcatgattctgctccagtttccacagatatttgctgaaccgttcctgctcctgtgttccattctcctgctgaatctcctgtgccgcctgattcagctgctccatagtcatatccagtggattttccccacggcggatcatttccagcgttactgccggtttcatattagaaaacgcacgctgcatctgctcatccagtgcttttacttccataatattttccggtgtaatttcggtattgttatatgccagtatccgcactgcacggcggtttgtttcacttgtatccagctgcagatcctgtaaaatatcgtccacattggaaaatgcctttgttatggaatcccccatgtcactgcgcggagcagtcatcagtgtttcataactttcatttgcctgtgcaaatgcacgctgcatctgcgctccggcatcatgaatctcctgaacggaatcatccgcatccacctgcccgattacatatgccggctgctgtttcagttcggcaaacacatccatggtttctgccataagatccacatttttttcacttggctcaactccggcaccggcaagcaggtctttatagtattctctctcctgggattttaaatcctcgaccagatccgccagcggtgtcagatccatctctacgcctgctttttccatcgccacggatgcctcactggtcattaccagacgcgcttcctccatctgtctgcgtgcagtaatcatggaagcatctgacggacgttttcctgccgcaattgccttcgccatggaatccacgatctgattccagtctatatgatcggcctgcagatcgtccgataatccctgcagatctgtcagatactgcagattttccggtgtaaggggaatctggtttgccaccagccacttgctgttgtccaccgcatgttcgtcatcggaaaggcctgcttctgcaataatctcacgaatctgcggcatcagggactcaaaatcaattccactctgctccggctccacaatattttctgcgctgctgctgtaattggacagatacagattgcggatggtcggctccatatcatttttcagaagataactcatcgcctgtttcgtgatttccggaatcgaggcagcctgtgccagtgcctccgcactgtcctgcacattttcctccgtcgccggcaggtcgtttgccgcaagagagtccatgatctgctgcgtcacaaccggacttccagtgatctcctctaactgttcctttgtgagtgttccacccatggaagacacatccactccggcttttgccagagccgctttaatcttgtctgtcacggtaataatggtatggctgtctgcatcggaaatggaaaatccgtcctcttccatcttctttaaatcttctgtggaagtggtatttgccactacagcgatttcgttgctgcgcgcctgtcccgaagaaatctcctgccctgcaattttttccgctactgtcttttcttcctgcccctgctttgccgggttggaatacgttgccatatcgatatttccagcctcggacaccgcagttttctgctgcacataggcttcctgtccgccaaaagctgcaaccgctccggcatccggcatatttgcctgataagccgcaattgccctgttactgttatcacgttttgcattccgcgttacatcttcccatatatttttctgctcaacctgcatgtattgcctccgtaccattacattttacgttataacatgtatcggcaggttatcccggaagctaaaggggaagatccatataaaaagatccggagttttcaccagatcttttttcctgatttacgattgtttcattgcctcttcatattctgctaatgtatatttgataagaattttttcttttggcacgccaagttcgaccatgtttcgaatggatgatatgcgctcttcacgccggcctgtttcccgaccttcacgcaatcctgtttcccgatgctcttcccatgctttacacaaatctaccacctctttctcatcctcacatgctatttcaatcccggtaaaaagacagatcgccgccacagtttctgaatccagccgggaaaacttttccggatatttgccaagcagttcctgcacttcctgctcactttcggatgcccggataaactgcagcaactgtccaacttctgtccggaatacggaaaaatcttcgatttcctgtggagccagcagattgatccggtaatccggtatccacggctttaattcttcatctaatgtgccaaacatctcgtgcaggcttcgcggtccatcccatgcttctgctccaagatacaccgtaatcgtaataaccggagtcagggtgtcattcctgtgaaaccctgacaaaaattctggttttgttccccatttcttttcctttttgtgtcgttttccagcctccctgacctgtgccccataatttaacccggcataaaccatgtcctttaccggcattgcataatgaatatcgctttgcagctctgccccaatcaaaaccagatagacattttgatttttcttgattataacacgttttaataaatctctccacttctgaaatgaaatttcttttccatccattccaagcaccgataacaactccgttgtgtcagttgcttcaagtgcttctggcaggatgaccgttctacctccaaacagtaccgcattacacatatctgcaaaacgtctgttatcggcaaaatactcgtttgcctttcggtcttttgcccccatacatcttctcctttgtgatgtcctgctatttaattttctgttacactgggtatatcgggatgaaactcccatgactgattccggtcataaaatatactttccttttatgaccggaacctatgtgataagattaccgtattttcctgctgctgtcaatcttttagcgtcttttattttccaacaaatacaattttgttatcctgccaatagttaatatcgtattccagttcaatatgtttggagtctttcgggacttcaaaataaaccgttccttccgtctgtcttcctgcggataaggttgcgtcaagaccactgtcatccccgatccactgctggtctgccttgctgttgtctgcataacattcccagtccatcattgtcgacacattctgatcggtatccgatgtattttcaaacttaaacttgaactgccagtattcgtaccctttttttggtgtgatgtattcattatcactcttatattttcctgccgaaacaaatgtaattttaaaatcttctgtttctacaacatcgcccacctgaaaaacattgcttttgtcctgagtttctgtatcgtctgttttcttattttcagaagatgtctgcttgtcatccgaaggtgtctggctgatcttctgtgggttcttatccttatcatccccacccccgctgattgcggcaatgacaatgatcacaatgactgctatcacaatccattttccaatccctccctgcttcttccggcagttcggacacaccttcgctttctttgggatttccgatttgcagtatttgcacacttttgtttccttttcttctgccatattccttcctcctcgtttgtaattaactgactctattataccgtatctgtctttcatccattcggttctcaaccataaaaaatagcttccgcatatgattggcatccgtcatatgccaatcataccagaagctgtttttttatggtctgcccacagcagacattttctatttattttcccacaatatgcatgacatccacgcgcaaatagttctcaattgcataccctcccacgaaaaatacaaggctaagcaccagttccagaataatttttgctgccacaggcattctggaaaacggatagattttttatctgcggtctgaaaccgctgttttgcatctattaccgttgcttttaaaataattttctgcatattctgcgaaccattgtataagccgtcccccggtaatttcccggtcagcatttcattgcatagtacccctacagcatataggtctgtccttgcatccgactggtgaaatccaaattgttcaggtgctgcatatccaacggttccaagtaccacggtatcttttccctgttcttttttgacttcgcgggcaattccaaaatcaatcagttttacaatgccgtcatctgaaatcatgatattcccggcagtaatgtccctgtggacaatgccaagcgcatgtacctgtcccagtacttccagaatatccgccatataatctttcacacgttcttctgcaaacacgccataatattccagatactgctgcacggaaatccccgaaatatagccggtaatcagaattcccctttcctctcctgctgcaaaatcgtatatgttttccagatgctcattgcgaatggcaatcagcttttcataaacagggattacagaagctgctacatatttctttacaaaaattctcccgttatcacggttttttgcaagaaagatatcctgttccccaagcggacaaatcgtttcatacgtttcatccagatacccatatttcatatcctgattcatatttgacagttcctcataattctatatataatgtctgttgtcattatagcaaaaaggacaaaccatgtgatgaaaaaaaccgaagaattacttaaaacgatccagtcgtgtaaaaattatcaggattttatttccgaaagcagacaggaactgatttccgtccggaaattaggggaagcctttcaggaaatcctgacacagaaaaaactgaaaaaaagtgatgttatccgcaattccggaatcgaccgtggatatgcttatgacatcctttccgataaaaaacagccttcccgcgacaaagtgcttttgttatgcctgggagcctctttctcttttgaggaagtacagacccttttaaagcaaaccggctatcccatgctttacgcacggatagccagggatagtgccatcatatttgcattccggcatcatatgtcgccaatagataccaacgaactgctgtatgaactccaatttgaccttctttcataataagcagttatgttatattttaaactgttctattattttttcaagttcgctgacaatttcccggttgttctctgaaatccgctgcgccgcaatccctgctgaacttttcgccatctttttagattctacgtaattttcggacacgtattccatcctatttctgtgcaaacgcaagcagttcttttcttacatctgccagatattttcgtcctgccacaatccgcgttccatccgccatgtaaatcagacttccaactatagaatccacgtacacgatatttataatatatgatttatgacaacgaacaaattgcggaggcaatcgtttctccatctccccaagggaaactctctccgcatatgccatatttttcatgggagaccttattttatgtctcatcttttatcacatagcctatttcactattttttactatattctaacactatcaaaaccactccacaaaatagtactattacagaacctattagaaatggccacaacccataattatttataaatccaataaaatgatttgtatcttcatacattaccctgtcaaaggttgaaattgcactcaatactataatttccaaaaaaccaaatattaaaaaaattgttccaagatattttttcattctcatttttctcctaattcctctcattatacagctttatctttttcccatttattaacaaatctattccatataaaaactcggcagaaattatccccataaaaacagcattccctaattttacattgcaaagatttaaaaataccgcacaaactactccacctgctaatataacaacaccgattttacaatagtttctcttataacctttcaagttttcatcatgaatgacaggttctgtaaaaatattaatcaataacaggcctccaatataattccgaagcattaaaaacatcacacaccaaatcaacattgggatcaacattttaaaataccatgcacacacaaatataaccataaagggaatactcatatttattttcaccatttttctaatatactgctttcattatatcatatatacataaaaatgctgttcttccctctctttttgttctgtcgtttaaagccaatattttgcagttcacaccaattgcaccaattctattgctttttctatacaaatatactagtatggaattaaatatatttttaaaaaaatattatgtcgtcaattaactatctatcaggataccgagtcatacactattaatggcactttatcagatacaatttctgatatcacggatttaattttgagtttttctgcttaaacaaatggttctataaaggatatacaccacagaattggaagaatggagatgattgaaatgcaccgtattccacttaaaattgtgacaagattatccgttatatttacggtcataggtttacttcttgtgatcataggtatttgcacaggaactatgataggattgataatattaggagccgggttagtggaacttgttggaacgataatttttattgctgtgttcagaagatgtcctcattgtggtagttttcttaaaacaggttgtaatcgatattgtccacattgtggtaaatatgtgaacgagaatgattatatttacttctaagcaatgatcctgtttttaagttgtacttgaaaagactgcgctgtggtttatggtgttgtccgggcagatatgaatatccgtacaagacgcgatgtcaagaaatttttagaaggactctctaccggaagttccagccttcttaagaatgtaaccggtggttatcattaccatacaattgaagctgaatccgaagagattttagatgatattcaaaatgaactcgcagaaaaaggttttctggccaaactgcaggattatgaacctgtagatttctggggcgaagaagaatcaaatacaaacgtttaatgcaatcaaggcgtcagtccggtatttccggaactgacgccttttaagcattggaaattgtcaattccactgttttgtcttacatatacttcttcacaatattctccattactttccacttatgttccatatcagagacaagtttaaactgtgtccttgcccggtccaaattctgccccggtctgtgaattttaaaataaatgtctccctgaatataatccataagaaacctcattccacattcataggtcataagcctagcgcccatcggaagcagctttatctcttcctgtgaaagttttccaccacatccctctataaagccattcgcacatgcttcaaaaagttctaagttgaaccacactttatccagattttgttcatcctctaatgctgtacttgctccaatccgcaccgcatctccaaaatcattcatggctgccccaggcattacagtgtccaggtcaatcacgcatattccttttttggtatccttatccatgaggacattattaatttttgtgtcgttgtgtgtcacacgaaagctgatttttccacttctcaacaaatcctgaaagcagtccacaatttcttccctgtccaatacaaactgaatttcctcccggactaaatccgctctaccgcacacatcctcttccactgcctttttaaatctctcaaatctttctctggtatcatgaaatcccggaattgtctcatgaagtgttttcgccggataatccgctaacatactttgaaatctgccaaatgccagaccgccctcataaagtatttcaggattatctatcaaatcatagcttacggtattttcaatgaatacataagctctccaatactcaccttctgagtccacataatagggtttcccgtcttttgccggaatgacatttaatgtctcccgctctggatttccaccgttagctgaaatttttctttttaaaaattcagtgactccaacgatattttccattaattcaaccgggtttttaaaaatactcttgttcatctgctgtaaaatataatgcctttttactccttgttcattttcaaatgtaacacggtaagtattattaatatgtccatttccccatggaatttcttctttatatacaccttcaaaacagaaatttgcagccacttctaattttccgcagagctgttttggataaaaattattctcttccagctttttcaatgcagtcataaccattggtttgtctttcctgtaggtaactccataccacttttctgttgtaagaagaacttttacttctgccttattgttatctaacagtctgctgacaactgacggaagataatattcacatttcagtggattatgttgcagcccctcctgcagaaaatcacgaaatccatactcaacttctgacaaaaatcccttgctaaatccccataaattcatggaaacaatcgtatctcctgccaattccgtataactttttccatcatcttccgtatatgcggcattctctccacgttttacaatcgttgtatgttctattacactgacaagttttccagcaccatcaatctcacagacacctcttgccacacttccattctccgtcaaagtatttttcaactgatatcctaccattgcatactgatacttttcattatcttcatgcacactcagataatcataaatctgcttaaatgcttctcttccataatagtcgtctgcattaatcactgcaaatggtccgtcaatcatatctttacagcttaaaattgcatgcgcagttccccatggctttactcttccggccggaacttcaaatccctccggcagattttccagctcctgaaatgcatatcttactttcataatcttttctatacgattccctatgacattatgaaaatcttccgcattctctctttttattacaaaaataacctcttcaaatcctgcaagataagcatcataaatagaaaaatcaacaataatatgtccatattcatctactggatcaatctgtttcattccaccgtaacggcttcccattccggctgccataattacaagtacaggtttcttcatattctttatacctcctgattaaacagcgtaccatttaatctcatttgcctctattttcaacgcaaaactgcttccatcgccgcgatagataaccgtattctgtggctcgtaggtattatttacaacacagaatttgccattttttacatatgcatgtacttccacattgaaatttgtactaaaccactgatgtaataaactttcgccatgtgtactccacaaaatgcttcgataaagaattctgctgttctcaaagctatatggcagtccactgatatagaccgaacggccctcgccaaattcatgcacagccatctgaacttctttgtccctctgtaccagaatttctgttccctcatacgcaaacatattcttcttgccctctccgaagtcaacaggctttgttgtatctgcaagaataaagtgatttttgtgttcttcccagttatacttatcgtagtttaaggtaaatccggtttctttttccacaccaattaaatcggcaagctgcagataatgtccctgatactggtgtcctgccggttccccgacaccgataaatccaccgccccggtagacaaattcacgaatggctgcggaaataactgcattctcccagactgccccgccggtgtgtgccgtatccccgtccccgacattgataatgacatcaatatcctttaatatatccttatcctttaaaatatcatcaaaggaaataaatttcacatcaaacggtgcgccgcttaacgcctcgataattcccgcataactgtaattctgtttctgatataaggcatggtgtaccatatggcagccccagctgcggattttgccccagctgtttaaaacagcaaccttcttcacacagtacggtgttgctccttttgcattctcatacagttcacggaattcattgcacacgctctccacatagtccaaaaactccgggaaatctaatgcaagctttaaatatccgccatatccgatacggtcgattggttttcttaagatggcacggcgtgctgtcacccagttttcctttgcttccttgacaggatctccgccctcatggaaggtgtccgggaaaaagtatggaaggaatcttccttctgtatattttacaccttcaatatcagagatcagacgaagtgtacttccgtttccaacgcttcctaccactgcgtcaagaccgatcgttgcaaactcttccatgaatggttctgttccgatccagtgatcccccaaaaacatcattgcctctttgccgcattcatgtgtgatgtcaaccatctcttttgcaagctttgcaacttccctgcgctggaatgcctgaaaatccttatattctttaccaggtacacggtactgattgttataatatccctggtcaatgatatattccgggcggaatttataacccatttctttttcaaactgctctaaaatataagggcttactgacgcggaataaccataccagtccacatatttttcccgctttaactcgtcaaacatcaatgtaaactgatggaaaaacgtcgtatagcggatgacattgacatatggatgctctgcacagaacttgcgcagacgctccatggaatatttatgtgttttcggctgtcttacgtcaaacgtaatctgatgttcgaaatctttccagtcatttgtcaccgcattgtacatatgtaccggatcccagataatatatgccagaaagcttactgtatattcatgaaacggttctgcctcatgaatacagacgcaccctgactcctcattatattcccactgtttggtcgataccacctgacctgtggaacggtcaacaacctcccaccatcgtttaatatcatctcttgtattgacctgcattaactcatccgaaatccccttcatcagaggaatttgcagttcgctttcaacagccgtataaaatccactcataatataacactgctgcacctcatccgggtttgccttcgcccactcattatcttttctcgtggtgtagtaagttgcataaatctttgccccggtctttgtcagctcttccgggaattctgttccgtcacaatcgcggattgcatctgcaccccagcgtttcattaactcaattgtctctggaaccacatccagatttgtaggaattgtgacacggcctgtatttttctcactcatttttcttcctcactctatttcatccatataattactttcttttcttcttttctgcaaaagggcaattataaatccacaatgccattaataaacagataattccaataagcataattcctaaacctgtcatttttcctgtcataccccatccaaaaacagacaggcttattccggcaataaaaagagctgccattaaaattattctgcattttgtgtgctttttccaaaattccattttaatctcccttctcatcaaccctttaaaccaccaacagtcattccctgtgtcagtttattctgaacacatatatataaaattaatgtaggaagcattactattacaagtcctgcatacataattccatactgtgctgctgactgctgcgcctgcatcagatttaataatcctaccggtaacgttttcggtccctttgccgaactcattagtgtcatggaaatgatatattcattccaaaaagaaagaaaattaaacaagattactgtaataatagatggttttgccattgggaaaataattttccacatcgttgtactataacctgctccatcaatatatgccgcctcttcataatcatgtgccaatgttgaaaaataccctgacaacagataaattgtaaacggaagtgctgtcgcagcatatacgattgcaagtatgaccagattatttaacagaaaacttttcccaattactgatttcagccaattgtctccatctcgcagcatcagaaaaattggaacaacaatataattcacgttaataaaaagaccacccataaaagccgcatttaaagatttgcttcctttaaatttaaaacgtgacaaacagtaagctgccggcagtgcaacaattaaaagaattacaagtgccaaagctgtaaccaatacggagtttaacatgtaatctcccatttttgctgtattccaggcatcaataaagttctgaaaataaaaacccttcggcaaagtccacggatttccataaaactctttattttgcttaatggatgccataaacacccatgccaccggaataataatactgactgcaagcattattaaaactaaatagataaaaaatttatacaaccgttccgcagaattcggattatttttctctctcatattttctctccttaaaactccagtggttcacgctctgtaactttatttacaagtgcagacaatgcaaacgagaaaataaatattacaacacctattgccatactgtatccatataatccggcatccttctgtccatacatatagcttagtgacacttcagaagctccgtttgggccacctgaagtcatagcttttacaaaaagaaatgccatattaatagtagaaataataaaaaatgttaatgttgtacgaatattagtccagatcaacggaattgtaatctgaaaaaactgaacaagcctgcctgcaccatctaatccggcactttcatacaggcttttcggcacactcgccatagatgccatgtacatgaccatatagtaaccaatcgcctgccagatcattgcaataataagactgacgatcacaagcgattcacctttccacaaaatcgggttctccattttatgaaacagtccgataatactgtttagcattccgttctccggcttataaattgcagaaaaaatacctgcaattactacaaccgataaaatattgggaatataaaaaataatacggaaaaaattctgtcccctgattttttctcttgacagaatgcctgcaaaaacaagtgcaaatgcaaaggtaactattgtaacaacaacaataagtaaaatcatgttttgcatggatcttataaaattagtatccgatattaatgttttaaaatttttcaggccaacaaatgtttcattcggtgaatatgcacctttttcaaataacgacatcctgaatacatttaaggtaggcaatatcataaacacaaaaaataaaattactgctggtgctatgcataccgccaaaaaaccgcttcgtcctctggcttttttcatactttcacgttcctttcaaacaaaccgtactatttaaaattcggcggacaaaaatcctgtccgccgactcatttttaccactatagcattaaggaaaactaaaaactcttatttcaaatttgcccgcatctggtcacttgccgaaataattccatcaatccactcctgctctgtcatatctcctgataccaaagagtttacagggtcaaagaatacagtacgtacttcaatacccggaattgcttcaaatgatgcaaaattgcccatggctgcctttgctccattatcatagatagaataaaacatgacattatcaccttctaatttatctgcaattcctaataccggctgaatagctcctgcttttgcaaaaatttcacatgctttatcactgtataaatatgagataaataattttgctgcatcctgatgttctgcaccagaaggaatccatgcctgctcaaaccatgtataactataactgtctcctccctcttttaccgctggaagagctgtcatgccccacttaaatccatctgcacgaggagcatctgccatttcaccgacaatccaggttccatttggcataaaaattgccttattatcaagtaccaactgctggttttgtgtaaagtcctgatcatttgcctgtgccggtgtaataggatttgtgtactcagctaactttgcaacaatatcaaaacatgtctgtgcttctggtgtttcccagataccttcttcataatttgtagccttatcaaagaattcaggtccgcctgcggcatacattaatgcatagaaaaatgcatcaaaatatcctgttgtcggatatgtaaataaataaattccctcttcttttgctttatctccaagttcccacatttcatcccaggttgttggaacatcccatcctttttcttctaaaagacctgcattataaaacagaccacatggggaataaaacattggtgcaagatatgtctttccatcaccataaggattcgtcaatgatgtatctgtaaatcctcctgcaatcttctctgaaacaagtttatcttctcccggaactttcatagataagacatctgtaatgtcagtaatcatatttcccttaataaactgttccgttaacgcagcttcacgtcccgtggccagatgaataacatccgggtattcgcctccctgcatggatggtcctattacatcctccaattttttatctgttgtaagttctacttgaattccggtttcttctgtaaatgcatctgtcacttcctgccacatttgcgaaccataacctgtctcaatcgcagctacactgattgttgttccagcataagctgcatatggatcatctgatgttgtctgtccagtttcttctgtcttgctgttatctgacgcagaattctccgttcctgaatctgtaccgcaccctgcaaataaagatgctaccattaccatactcatcattgtacataaaatttttttcttcatagtaacctcccatttttgttattttttactataagttcttatgtttccttccctacatttgttattatatagtacgccatctctttttcctatccatatattgctctatattttataattcttgctttattttaaaaatcttgttattttgttttttttattgtatactaagtacaacatcgttccattttgaccaggaaatcattgcaattataacatgaaaggactgtattttccatgagcaaccgcaaatttaatctggataatgaggtacagccggaaatccatttccgcctgctttccatatcagcatccaaatttgaaaatgactggacttcgtttccccacagccatcattttacggaaatcttctttattaaagacggcaccggacgcatgctgattgaaaatgaatctcttccggtctcctcaaacagccttgtcgtgatcggtgcacaggtaacacacacagagttttccgatccggaaaatccactggattattatgtgctcggggtggaaggattaaaactgaatactgacaaagaaccggaatacattcatgtcccggcttttgcaaactcgccttttatccgccagtgttttgaaaatatcctgcgggaaatgcataacaaacaggaccgctacgcagagatctgccagcattatctggatattttaattttatatttctgccggaaagaccatgtatcctatgaagtggtggatgcgcagaacagcagccgcgaatgccacaaggtaaaacgctttatcgagcacaattaccagagcatgatctctctagattcgcttgccgaaaactgcagtctctcaaaatattacctttcacaccgttttgcagagctgtacgggaaatctcccatcgcttacctgaacgaagttcggctggcgtctgcgcgtgacctgctgctcacaaccaatcacagcatcgaagagattgccggatgtatcgggttttcctctaccagctatttttcgcagtccttccagaaaaaatttcatgaatcgccacagcagttccgcaaatcccaccgtgtcaggacatgaccatgtttcattttttacataaaaaaataattttctaaaaatttccccgaaagaatatcatatctttcggggaaaggaaatggatttttattcttccgtttctggaatcctggtggtacatatatcagattattcagggaaactatgcctatcagccggattggaaagagaatttacaatgttttggactaaccatcgtgcatattctgatcacatgtattatctatggcattatgggtatgttttgttgtgcaacatccttttatttccgcaaccgaaaaacggtatattttgtaagtatatttttctggctgattgaaattttaaaacctggctccctgcttcgcaccaactctattgcttttttatgcaaatatgctattgtaaaattaaatatatattctggaaaatattatgttgccaattaactatttacacgaaaggaaaaccatgattaagagtaaaaaaatactataggaattgtgaaagatacaatttgtaaaatcgccctgaaaaaagcaaatacaaactgtcttagccttatgtatgaacccccaaaaccaaagtgcacttggtatcaacctcaagatcaacattatttacattcaaataagaaaggtggaaattgattataaaaaaatattaagtataattttagttatggtattcatgattactttcaataacaacgtatatgctgcagaattagataatatgcaacataacgaccaagcatatgtgttaaattcattttcaggaaataacttggaaagtatttcagtgagattttaaaatcacagaaaatcaaattgaatttgaacagtttggaagaaattttttattttctatacacaaattaaatatggatacaagtgacgggaaaaacattccagatgccaatttttatacaggtatatcttctactatcttaaaaacaaatattttatttgcctacaaatacaattttattgtcctgccagaaattaatatcgtattccagttcaatatgcttggagcgccgcattctcctttgaggaaacacaaacactcttaaaacaaaccggatatccccacggaataagaggtttgcgatgttcactatgcttccattcctttaaataatccattatttttctatacatcactgcacctccatgaaatgtttacttttggcatatcaattattcatgtaaaaatcaacgtatttttcatttgtttttacactaaattgcatgaattatttctaaaattatacattatttaacacgattccccgtattacgatcaaataattaaaaaagaaaccgggcatccacgttgtaaacatgaactcccggttccacttttttagttaaaatttaaatactgctactccgtaaggcggcagcttatatccgatcgaataatcccgtccatcgcaaggcttcttttccgccttgtaggaaaccggacgtttcgtatcttctgtgtcgcttccgccaaactgcggatctgcactgtttaataccagcttataggtatgtctgcccggcacacctacccgataatcgtcacgctctactggtgtgaaactgatcacaaaaagcaggttattctttccatccttactctttcgcacaaagctgaaaatactgcgttcgtagtcgttggcattcatccactcaaatcctgcccaggtcgtatcctgctcatacaggcatggatttttgcgatacagatgaagcagtgcctttacccagtcctgcatatgtttgtgtttcggatcatcgagcagataccagtctaactcgcgcttctcgctccactcacgctcctgcgcgaattcctgtcccataaacagaagttttttgccggaatgtcccatcatgaatgcatagcccgccataaggtttttaaacttatccccttcgagtccgggcatcttgttgagcatggaacatttcagatgcacaacctcatcatgggataataccagaatgtacttctcactctcattgtaactcatagcaaaggtcatcttgttgtgattgtccttgcgaaaatacgggtcaagcttcatatagtcaaggaaatcatgcatccagcccatgttccacttgtagctgaaattaagtccgtcatcctctaccgtacccgtcactttcggccatgccgttgattcctctgcaatcatcacagaacccggatttcttccgagaatcagcgtattgatgtgcttgaaaaactcaatggcttccagatttttatttccaccataaatattcggaacccactgtccatcttccttaccgtaatccagatacagcatggatgcaactgcatccacacgaagcccgtctacgtgataattctcaatccacatcagtgcacttccgatcaggaagttcttgacctcattctttccgtaatcaaagattttggttccccagtccggatgctctcctttgcgcgggtctgcatattcataagttgcagtaccatcgaactctgccaatccatgcgcatcttttggaaaatgcgccggtacccagtcaaggatcacgccaatcttgttcttatggcattcgttgaccagatgtgcaaaatcctccggtgttccataacgggaagtcggtgcataatatcccgttacctgatatccccaggaaccatcgtatggatactcggaaatccccatcagctcaatgtgggtataccccatctccctgacataaggaatcaatgtctttgccagatcgcggtaagaataaaatccatcatcgtcccgccccggatggcgcatccaggaacccggatgtacctcataaattgccagcggctgctcatatacttcctctttggaaagtttttttctggcactcatccattcgctatcagaccagaggaaattggaaatatccgtgacaatggaagctgtctccggccgcagctgtgcataatttgcataagggtctgctttgtacagctttcttccgtcctgcgcgataatcaggaacttgtacatacagccaatctggacgcccggtacaaacagttcgtatacgcccatcgtctccggtgtcacacgtttcatctcgtgggaagtttcattccatccattaaattccccaatcacgtatacacggtccgcatgcggtgcccagacatcgaagcatactccctcttctccttcaattgtcattttgtgagcacccattttgcgataaatatcataatgtgttgcctgtccaaacaggtaacaatccatctctgtaaaattactcataaataccctccctgtcttctcttatctatcttactcgaaatccttttccgttagtacaattctgtcatcatccgtataacggctggcggtcagaatactgatagctttctttaaccctccatgtgcctcccgatgaattgcttcatccacaatgtctttcacctctgtcagggttgtcgcctgatccagtctctgaatattgctgatccggttatacaatgccagaaccgccatgtcgtcaattttgtatccaagttctctggaataagagcgtgcaaacgtaaccagctcatcatttgtaaaaatcggaactgagatctgttcactgaattttttggcaaatgtttcattctgcgcaaataatctcttgatgcccttggatgtgtcttcgagtataacgaaaagaccactctcatctgcgtccagcaatccggataactccgacacggtctttttctccatatctcctgcctgttcaataatcaggcatcctcctgccaccttatccagcagcccgccgacatttttctggttcaatgcttccgcatggatctttccaatctttccatccaaaaccccggtctcctgctgcaggactttgatcatgctggtggcaagtgttgtttttccacttccctgtccgcctttaattacgagattccccctcgatgcagtttccttatttttcagatgggacgaagcaactgtcaacgctttgcagagctgatcctccatgcccttcaccggcataaaataagaaaaaatcgctttctgttcatcggtcagttctacaagcggaagattctgtttttcctcttttcccagatccaccggtgtgtctacctgtggaatatgtactgtttttcctttccaggaagagcgatctgtttttcttcttacaaaagcaaactcttcttccctctcctgtgcaagtgttggtttctgtggcagatcctcgatcggaacctcctcaaaatcctttttctttgttgtatctgattctgtctttgtttccatttcttctacaccacgattctcatttaagtttttgtcatcttctgtcacatcggatgtctcttctgccggtttctgtgcggcagcttcagttttctttttctgctgggaacgtaccatttcttctaaagatactccctctggccaaagttcttcggcatctgtatccctggcaggctgttcctcttttttgttctcttcctcttcttcctttcgttcttccggcccattcgttgccggcggtgtttccctttccggcgtctgtggcggtgtttccgtcgtttcctccacaatatccgccttctctgccagtaccgcatccagttttggcaatactcctgtcaggcggtccataatatcgcctgcctcctgcagtgcacgcgctttggcggattcgagtttccgctttctggcatcttctaatgcagcttccgcagccttgcgcattttctcccactcactcagcacttcctcaattgtcatctggcctgtgatctgatgctcaatcatgtttttctcatttgtcatcatgctcatctgaccatcggagtcttctcccaacaactctttgaaatttgtcttgagtgaaccatcaatctcctcatctgtctcaatgtgccgtgtattctgttccggctgtgcctcaggcttttcttcctccatctgcattttcagataaggaacatcttccaccatacggttgatattgtccagcgtatccgtgacggtttctttttcggttgcatccatgatctgctgcataccctttgcaatttccgcctgaagattgacggtattaaaccgttctgtgtttacttctacttttggaattgcgaccggatcatgcacggtctccccggcacgcgccatctcctccacatcaatgtgtgtcaaacctgctctgtcatcttttgcctgacaaaacgaccgatacttttcttcctgtgttttcgtcaatggctgatacagcattttcagttccaatgcacgctctacatatggcccgtctccaaaccagagaaccagctcatcacatgcatcaatacacttctcactcatccctgctttgtgatacagataagcaagctcatatgcccactcttccgtatattcctgctccttgagttcttcaagaatcggtatcagttcttcataagaagccccctgtgccttctgtatatcatagcgaagtacatatttaagggtgtcatgaggcgcaatctccacaaactcatcataataatcctgtgccgcctgaaaatctttcatcttgaccgccacttccgcaagacggtaaataatcattcttccgatcggcgagcggtcatatgccatcagcaaaacttcccggctctcctcataacgctgtactttttcgtacacttccccagcttttaccagaccatttacatttttaaccttattccaattgatagtatctgcaatatctgctgcctcatcgtatttctcttccgcataacgggatttcatctgatcaagcttcagattatattcgtatttgtccaattgttatctccttaaaatatccccaaacaggtctatctgtctattttcaagtataccataggcggcaattagtgtcaaaaaataatccgaaaaaaagagctgcacacaaacgcgtacagcccttgaaattactggtttttctttgtttcgtctttctttccggaatcttttaaagttctctttttcttttgtttttccccgtaatatatgatcgcactggttgcctcatctacaccggctgcctccacatatgcctccgttacggttgtaaggtttttcttccgtatgctgtggtttaccagtctgcggataatatagtaaatcatcgcaaacaccggaaccccaagcagcattcccagaaatccaaacagtccgcctccgatcagaatcgaaaacattacccagaacgcggataatccggtggaatcacctaaaatcttcggtccgataatatttccatccacctgctgcagaataatgataaatatcagcagatacaacgcatgcagcggactctggatcaccaccagaagaagtgtcggaatcgcaccgataaacggtccaaacaccggaatgacattggttactccaatgataaccgcaaccagtatcgtatccggaatatgcaggatcagacatccaaaataacagattactccgatgatggcagaatctataatctttccaatgatgaaaccaccaaatacttcatctgccttgtggaaaacttcgataataatgtttccatgtttcggtttaaagatcgcatacacaatctttttgctctgtcccaccaggctttctttaatggataagacataaacaacgacaatgatcccaatgatgaagtttaatatggatttgaccatcgtgattacgccggaagtaatctgcaacagatattgctgcatctgtggaagcagatccttcgttgcccagttttccacctgatccgtcagttttgtcagcatatcactgatggtatctgtcactccataggctccgagttttccacttttcaccatatggatcaggctctccacattaccaggcagtgcttccaccagcccggtaacacttgataccaccgaaggaacaattgccgcaatcaaaagtaccaggatcaccagaaggaacaggattgccccggcaatggacaatccacgtgccactttagccgctgatttttctgatttcattttctttttcagaaacggcagccagcgccgctcctgaaatttcataaccgggttaagcagataagcaagtcccagtccgataataatcggctgcaatgcacctgtaatcagatgccaggtatctgcaacccccttgtaccggagcaccaggaagaaaaatacggtacaacaggcaaaggtgagaaataccatcaatccgattttaatcagaagaaccgtctgacgcatgccatcctcgctctgtttgatctgttccatctgtttttgtttttccacgtctgtcatacaagatctcctatccgcggtaataattgatcaaacagcctttgagaataatatctttctcatccggtgtcagttctcccatacgcagggtaaatggctttaaagcaccatcctttaccacatatgcctcaaattctgtttttccgtctgcgatcgcctcacggatctgtggaacaaacaggtaatccagattgtggaacggaagctctccctgatcaataacaaacgggatcataccccagttaatcaggttggaacggtatctcttggtcgcatattcatttgcaatgtttgcccatccgccaagtaccttctggcaggaagccgcctgctcacgcgcagagccgtctcccggttttactgcaaaaatcgtacttccaaaaccaacgtttgagcggttgacatcggagaacgttgcacgaatggtatccataaccggatgaatctccggaagtgcatcccccggacaggtatctgcctcgacagccttctgtgccttctgtacttccttggcacgtccaacatattccggatcctttctggaaagtgcaaactctgccagtcccagtgggttggaacggaaagaggatgtctcaccggaaggaatcagctcgtccgttgtggtcaccggatcgtgaatctcggaaacaactttcagcacaagattctccggaagcgggctcatagccggccagtccttgatatttggtccaaactggatctctacgtccggatctgccacacccttgctgtcaaatacacggttttcataaatggtcttatcaaagaagtatttcggcttgctgtagtttacatcaatatcggtagctgcggtaaggaatcccttatttgcagcggttgcagcgatagaacgcgcatccatcagtgctacggaagcaacctgtccgttctgtaccttagagccctcacggttcgggaagttacgtgtagaatgacggatggaaaatgcattatttgcaggtgtatctccggcaccaaagcacggtccgcagaatgcagtcttgacaatggcacctgtctccaacagattggcaacggcaccgttcttaacaagttccatataaatcggagtagacgccgggtatacgctcaacgtaaactcgtccgctccaatggaagaaccctttaagatatctgctgcatcgcagatattttcaaatccaccaccagcacatccggcaatgataccctgatctacatacagtcttccgttctttactttgctctttaagtcaaggtctacttttccatcaaagcttacctgtgcacgcttctcacagtcatcgagaatatccatcaggtttgcatttaattcctcgatcgtgtatgtattgcttggatggaacggcatcgcgatcattggcttaatctcgcttaaatcaagttcgataaagctgtcatagtatgcaacttctcccggattcagttcctcgaaatctccggttcttccgtgaatctcatagaattccttcacctggtcatcggttctccagatagaggacagacaggtggtctctgttgtcataacatcaacaccgatacggtaatcaacactcagattggatacgcccggtccgacaaactccatcactttattttttacaaatccgttggcaaatacttcaccgataatggcaagtgcgatatcctgcggtccgacacccttctgcggggtacctgtcaggtaaatgccgacaactcccggcatatcaatatcgtaagtcttatccaaaagctgctttacaagctccggaccaccttctccaattgccatggttcccagtgctccgtaacgggtatgggagtctgatccaaggatcatctttccgccgcctgcaagcatttctcttgcaaactggtgaataactgcctgatgaggaggaacatagattccgccgtatttctttgcacatgtcagtccaaacatatggtcatcttcgttgatggttccaccgactgcacacagactgttgtgacagttggtgagtacataaggaatcgggaacttctcaagacctgatgccctggcggtctggatgatgccgacaaatgtaatatcatgggaagtcagcttatcaaatttgatctgcagtttttccatgttgccggatgtattgtgactctttaaaattccgtatgcaatggtttgtttctttgcatcttccggtgtaacagtctttcctgtctttgcattgacagcagatgccgcttccggtgaattaatgacaacatccctgccgttgaccaggtatgcgccgttctcgtataacttcatagtttcctccttgttttcgaaatcatggttaatgataattatataataaaatgtatttttatgcaacgactgcaaacgtaatggatgccgcaaacagatcgccatctaccaggattgcaaactcaccgcccatcagctgtgtaagattctttgcaatggacagtccaagaccgcttccctctgtcgtgcgggattcctctcccctcacaaaacgctccgtcaggtctttcctcgctgctccctgttccggcagcggatttttcgaaatatttttgatacggaaaaccgcattgttctcctctacttccagatctacataaacccgggtattttcgagtgcatattttgccgcattggtatacagattttcaattgcacggtagagctgccgtccgtctgcccggatcatcaccgaattgtgcggcagtttcgtcacaatggtcagcccccgtgcctcaaaacgttcattgaactcaccacccgtctggtacagcagttctaccagatcgatggtctgcatatccagctggatatttccggaactgatctttgatgcttcgaccagatcctctgtcagctgtttcagccgctgggatttttcatccagaacccggatataattacgtgcattttcgttttccaggttttcacgtttgagcagatccacataattgacaatggaagtaagcggtgttttgatatcatgggaaacattcgtgatcaggtctgccttcatccgttcattccggatccgctcctgaatggcttcgctcagccctgcacggatattattcacagaagctgcaatgcctctttcctgtccgtgaaactgttccacatccagtgtcgtatccagtgcccctgccgcaattttttcaattgcatgctggatctcatatctttcgcgcgccttacgcgtacacagtctaggattctgtccggagataaacacccgtctaaggaagcttcctgcctgatagatcagactgtgtgtcagaagggtattgtttttgacccgccggacaatgctcatataaaacagcaggaatacaacatcgaccagatacccgactgttccgaccgctaccatcagtccggacagttcaaactggatgtcatggagatttctccccaaaaaaagtacaagataaatgaatgccacaaaaagcaccatctggatatccgtataaattttatcgatccaggtcaggtaaatggttgcatcctcctccgaccggcgccctgcaacacctgtcagataggcaagaaatacaaagcttccgaccatgccgatcaccataaacaggctgagaatacccagccctccgatatgtctgcgcagattgtatccgatcccatagattccgcaaagcatcataatcaggaacatctgatgcatgacaatggctgcgcccttttttccgctggagaattctttcatagacagctacgcccccgcttcgattttatagccgacaccccagaccactttcagataccgcggttctttcggattgatttcgattttttcccggatatgccggatgtggacagcaactgtattgtctgcgccaattgcttcttcattccagatttcctcataaatctgactgatggaaaatacttttcctttatttttcatgagaagcagaagaatgttgtattcgatcggagtcagtttgacctcttccccatctaccgtaactttttttaattcatcgttaataaccagaccgccggcttcataaacggcatcaccggaaggagtgctcgaaagtgtggtataacgccgcagctgtgacttcacacgggcaaccagttccagcggattaaacggcttggtcacataatcgtccgcccccacgttcagccccagaatcttatccgcatcttctgtcttggcagacaggatgataatgggaatgctgcttgttttacgtgcctggaatgtcgcacggattccatccagtttcggcatcatcacgtcgatcaccatcagatcaattttctttgtgcgaagcatctccagagcctgttccccgtcatatgcttttactacctggtatccttcctgaatcaggtaaatctcaattgcgtctacaatttccttgtcatcatcacacaccagaatcgtcatgcggatgtcctcctatcaggttcttgatcttgttctgaaagccggcggatttttctttttcttctgctgcttcctgttcttcctgttcatctttccacttaaaataatcagcatccagattcacacgcagttgttcttccagctgctttaactcttcatcgtcatcttctaccgtaaccggtgccggaatctccggcttcggcgacagcttctttggtttttccaccggcttttccactggcttttctactggttcttccgcaaggtcttctaccggttcttccggtacggaaagtcccagcttatccagatattcctggttaatcttaatatcggtctgccggtttgcgtaaattgctttttcttcccgcttctcctgctcgtactccggtcttccttccatcttttccttctcaatctcgcggttccgttcctcgatgatctttaagtacttttcggtatcaaccagatcctgcagctgtcctttgagttcggatttgttggttcttaattcctgttcttctttttccatctgttctttaatttcctgatagatggcaccgacctttttgtccgcctcctgcatgatatcctgcatacggtttaacgtttcatccatatacatgacagatgccgcataaatgtcctctgccttacggcttgcatcccagatgatctgatctccctttttatggaaatcgcgctctgccttgtcacggcttcgaatggtcagctcgtattcatccataatctgataaatacaggtatttaattctgccagcagatcaatcacctgctgcttatctatgataactttactcggctctttcggatacggctcactcttcgacagcaaaacgtgaagactgcgcagtaccttttccgtattgtcctgtgctcccatgtgtcctgattccttccataatagataattccgtactttctattataatcaatccccctataatacgcaatattttagattcttaggtttttctaaattttattacacaaaactttattttttacagacacaaggttataataattttttgaaaatgaacctgtttaataaaggatatatactatgaatatcgtcaaaacttacggaaatcatattaaaaaatatgctggcacccacccggcagtttcccgcaaaatgattgacatcggattacatctcgaacagttccggactgaacattttgcagaaaaaacaatgccgaaagcatatcagaagctgaatacgctcggcgtaaaaaatacgcttcatgcgctggaatacccggaatccacggtctggtgcaatctgtttgcacccgtggaaattttccagtgcttcggactcagtgcgctttccatggaatgtctttcctcgtttctctcaggatttacgtgtgaagactattttatcgaccgcgcagaaagccgtggaattgcctccacgctctgttcctatcacaaagattttatcggtgccgtagactccggaattatttcacctgccagactcggtgtgacaacttccatgatttgtgacggcaatattaacacattccgctatgtcagccggcacacggatcttgacacttatgtgatcgatgtgccggacagctgttctccggaagccgtggaatatgtgaccatgcagctgaaagaactgattcagaaactggaagcactgaccggaaaacgtctgtccatggatgacctgtcggaaacacttgcccgcgaaaaccagtcgaaagcttattacaaagagtttttaaaactgcaggcagagcgctattatccatcgacactgactctgcagatgtacatgctttttgccacccacttaaacatcggaacaccggaaacccttgatctgttccgcagttttgccgaggatatcaaacaatatccgaaatatgacggcacccggattgtgtgggtacatctgcttcctttttatcaggaaacactcaaacactattttaacctgaacagagattaccaggtccagtgtaccgaaatgaacctggattacatggacgaactggataccacccacccactggaagcacttgccactaaaatgctaaacaatctctataacggtccatacgaaaaaaaagcaaatatggtcgtaaaactggcaaaagaaatgcatgccgatggcgtcattaacttctgccactggggctgtaagcaatctgccggcggagtattccagcttcgcgaaacactcaaggccgcggatattccactgctcgttctggatggcgatgccatggaccgccggaacagccataacggacagatcaaaacccgtctggaagcttttctggaaattctggataaagagaggaattcatcatgttaggttatgtatgtaaatatacccccatggaattatttgaagccatggacacggaaatcacacgtctggaaccatccgttacggattttaaccatgcggataccctgatgcacgccaacatctgttcctataccaaggccgtgctggaagatgtgatggaacatgactatgagggtgtcattctgactacctgctgcgacagcatccggcgtctgtatgacacattaaaaagccagttcccggataaatttttctttttactggatattccccgcaaatttaatgattttgcagtgacgctctatgagcaccagctaaaacaaatgctcacggagtacgaggctttctccggaaaaacactggatctgaaacgttttgtttccatgatgcagaacaaagcggctctgaaaaaacaggaaaacacccgcatgtctgccagtgcagcgtccgaaaaaggaaacggacagaaactcaatatcggaatcatgggtgcccgatgcaacaatgaaatccgtcagctgcttgtcgaccgcggtgccaatctgctgtttgatttaacatgcaccggacttgcacgtgatttttccattacagaggatcaggcccttcattcttatgctgccgcgctgctaaaccagattccatgcatgcgcatgttaaaagcagcaaaccgtgaacattttcttgacggttttaccgaccgcctggatggaattatatatcataccgtcaaattctgtgactcttattcttacgagtatgcggatttccgccagcggctggatctgccgattctgctggtagaaaccgattccaccagacaatgtgccggacaggtccggacccgtgtggaagcctttatggaagaattgaaagtgaaaaaaggattgtccctgaccggggaaaaacaaatgataaaaagaaagggtgatacagtgtatacattaggaattgacagcggctctacctctacaaacaccgtaatcttagacgaaaacagacagatcaaagcattttcagttgtccgcaccggagccaaatcttcccagagtgcagatgccgcactggcagacgttctgaaaaaggccggacttaaccgggaagatatttccctgattgtatccaccggttatggtcgtgtcagcattccatttgcggataaaaatgtaaccgaaatcagctgccacggaaaaggtgcgcatcttctcttcccggacgttcacacgatcctcgatatcggcggtcaggatagcaaagccatccggctgaatgacaatggagaagttgccgattttgtcatgaatgataaatgtgccgccggaaccggccgctttctggaaatgatggcgcgctccctggaaatcagtatcgacgaacttggtccggtatccctgcagtccaaagaaaatattgaaatcagcagtatgtgcagtgtttttgctgaatcggaagttatctccctgatcgcacagaacaaagagattgctgatattgcacatggaattcacaaggcaattgccgggaaagcaatgtccctcctgaaacgtgtcggtctgaatccgggatatatgatgactggcggtgttgccaagaatccgggtgtcgtcgccgtgctggaggagcagcttggagaaaaactacatatctatgaggaaccggagattgtcggtgcactgggtgcggcattgtatgggcttgaggagatcctataaaccagaaaataattttacaacaacaatcgtgatacgatttattttccaatcgtatcgcaattgttgtttttctgttactgttataaatcatttgacttctgtccgaaaatacgatattctgtttttactgggtttataaaattatataccacaattacttatgcgatacatcgccattgtaccgcaatcaccactcatggagagcatttcgctcataaatttccattagaaccacaatttcatagaactggtcataacagctctgttttttatactttctatattgtaaaagcagatgcttatgatatatactaaaggaaaggtaggacactacatggggaacactgacattttgacaacttcgttgccagatgccggcacagaaaacacaacagaacacagcacgattttcgacgatgtattccgaaccattgcgcaaaaaatgccgcagcttctcattccgctgatcaacgaagttttccatacttcttacagcgaagaggaacagtttgaacaattgcgaaacgaacattacgaaaagtacggaaccgtgatcacggactccattatccggattggtggacatatataccatctggaatgccagtcctctaaggacaggacaatggttatccggatgttcgagtacgacatttcgattgcacttgaacatgcttctttgggggaacatgcaatttgggagattgcgtttcctcaatcgtgcgtgctttatatccgcaatcaccgttcgcttccagattatcatgaggcaatcgtaacgtttgcagatggtcagaaagtacgttaccgcgttccggttttgcaggcgaaaagatacacggtggatcggatttttgaaaaacggctgctgattctgcttccgtatcatatcttacggtatgaacattttttgaagcacaatggaacgaattcgaaaaaagtgaagcatctgctggacgatttccgggagatcaaccgaaggttagaggacgcgtccgaaaaagaacaaaagtcacatctttatatggatatgattgttttaattgagaaaatcgcggattatattattccaaaagacaatgatattaggaaaggattgggtgagattatgggtggtaagattttgaagttacggtccgaggaattactggaacagggcgaagccagaggagaggccagaggcagaatcgatgcaattcaaaatatgattgatcttggtttaaccaaagaacaaattttaaaaaaatattctccagaagaatatgaaaaagcattaaattctatgccagtgaaagcataaacacaccaaaagggattccaaggaatcccttttgatgtgtaatgaccatatttacttttactgtaacagagaaagtacaccctggttagactgattagcctgtgcgagcatagactgtccagcctgtgcaagaatgttgttcttgctgtagtttaccatctcttttgccatatctgtatcacggatacgagactcagcagaagatgtattctcggaaatgttatccagattgtcgatggtgtgctctaatctgttctgtacagcaccgagtgcggatctctgggaagaaaccttagagattgcatcggaaatagcatcgattgcgtaggttgctgcagaaccgttcttgtcagttacatttaatcccttgattccaaggtttgcagaattcatagtatcgatatcgacagtaattttatttgtcatatccgcatctgcacctacatgaaggctgaagcttaatgtgttggcaacttttgcctgaccaacattaatcttaaatgtaccattaccagcattaaatgctaaacctgtaccatcaccattcgttacagatgcatgtccttctgtatcaccgatctggtttgcagcaagcaattcctttcctgcaagttcatatgctttctgctttgtgataacggaagtatcattatcatcaacaccatctgctccggctgctccagatgcatcttttgcatccgtcaaaacagtcatggttgttgttccatcgcttactttaacaccaccctttacatagtcttttaaattagcgactgtaactgctgtatttgcggtatctgtattagcattatttttgaaagtactatctgttgtgagttcttttgatgtatcaaatgcttctgctgccgttgctccacctgctgtctttacatataatttatttccatctttatcacatacatcgccattagcctttactttaaaggttttatccccaatagtaaatgttttatctgggtcaccatttgctggtgcttcaatcagagccttagcatcagcttctttagaaccaattgtataattctttccaccaatacttacagtatcgccatcatttaactctttcatcgtaaatgtagcagttccatcgccattatcggtcaaggttccctttaatcctgcatcgtgtgcattcatgttgacagtcttctcaccgtcatcaccctttaacaggtaaatctcattgaatttggttgtctcagcaacacggtcgatctctgtatttaactgatcaatctcgtcctggatagccttacggtctgtatccttggaatttgtaccgtttgctgcctgaactgcaagttcattcatacgctgtaacatgctgtgaacttctgttaaagcaccttcagcagtctgtacagatgatacaccatcctgtgcattggaagaagccttgtccaatccacggatctgctttctcatcttctcggaaatggtaagtcctgctgcatcatctgctgcacggttgatcttgtaaccggaagataacttctcggttgacttagcctgtgctccggatgtgataccaagcattctgtttgcgtttgctgcctgcatgttgtgttgtactaccatactcataattgaatcctccttgaactcccactttgtggggtattatgttttttcctttggaaatccttttcctaaggtgttcttattgcgtcactttgcagtaacgcgtcacaagcatcttttgatgctttgcgaccttgtatcaaataagcggagcgtcccgggtgtgccccacctattaccagaatttaaaacagatcaggagttaaatttatctttcaaactctctgcatctttctttgcctctgccttcatccgctcgttccacagaatcctcttaatttcctgctgtgcctctctggaaatgcccggctctgcataataggtttctctccttcgtgccggattttcttccgtggtacttctggcaatattaagttctctcggggcatcaatgagcagccttgcgtgattacccgaaccaccgacatagaccacacggatgtcatccccgatatttacgtattgtccctgtttcaatgaaagtttcagcattttttacctccatgcacgcaaaacctttttgctacgttttgtatcttttatatcgtccgttcgctacggtttgttaacctctattttttataattgctacaatttgttactttttatctaatttttccattctcattcctttaaaaatcgtttatttttgtgcatattttacatttctatgcaacattctgtaactatatgactattttttcgcttcctacaataaattaacttctgttttatcaatagctactatctgtaacatttcatgatatgtgaaaaaatagactaattttaagaaaaggtggtattttattatgagtgaaaaaaaacttcctcagaaattgaaagaactgagaaaggtaaataattacacgcaggattatgtagccgcggtgcttggtattgtccgccagacatacagccattatgaaactggcagacggacaccggatgccgaagcattatataaattggcggggctatacaatatttcgattgacgatctcatgcatctgactgttgatattgaccgcgaagtttcttatgatgcaccggttccttcccagtccagcgaagacttatctgagtttcttgaattttttaatgatcccgcaaataaaaaaaagtacatgtttcatacgaatctggaaaaagaattgcttttttattttaacaagatatccgaagaggataagaaagaaattattgaatttacaaaaattaaggcccgcaagcctttataacagaaaaattgcttctccagatactgtttttaatggtatctaaagaagcaatttttaatactatggaaattacaatttcactacatgcactttattccggcttccgcaagcctcttgtattcttttccacaagcttgcgtgtcaccatcatctgatgtccacagccagtgcatttcaggcggaaatccgcgcccacgcgcaaaatctcccattcatggctgccacacggatgtggcttttttaatttcacaatatctcccacttcatactggtactgattcatagctggtctccttctttttctccccttatagacaattgtaaaacccgcggcggcaggagccggagtatgttttgcaattgtctattattttctctggctaacacttgatctgtgaaaagacatttccaagtccatcctggataagaagatccgcacgcgcatccattggagttgcactcttattaatcaaaacaagcttatttcccctgtaataatcaatcaggccggctgccggatatacggcaagcgaagttcctcccacaatcagcatatccgcatggctgatataaaataccgcatcctgcagtgttttctggttcagcccttcttcataaagaactacgtcaggcttcaccggaccaccacagacaggacagaccggaactccttccgagtggagaatatcttccgcgctgacaaactgtccacagcgttcgcagtaattgcgcaatacgcttccgtgcaattccatgacgtttttacttccggctttctgatgcagaccatcgatattctgggtcacgacccctttcagttttcctgctttttccagctctgccaatttgaaatgggtgatatttggctgtgcatccagacagagcattttgttccggtaaaaccgatagaactcttccggattctgccggtaaaaactatggcttaaaatagtctccggcggatacttatactgttgattatacaaaccgtccacactacggaaatccgggattccgctctcggtcgatacccctgctccaccaaaaaatacaatgttgcccgattcctccacccattgcaaaaactgttccgttgcttccattttttctcctttctccgcgaacagggaaaaaagaggctgtcaccgtgtgacaacccctgtctgatttcctgtgctatatggcaaattgatatttttaatattcttataataaggatgccagttgctactatacagcctctgtattataaaatacatctttcttcatctctccggcaatttgctttgcattctccagatcatccaatatctggtatgccggtgttgttgcgtcttttaaattctcctggagttctgccagtctctgtgcatcctgttgctgctgctcacactgctgctggatatggttcgcctgatttgccatctcatccatggaacttgaaatctcttcgctgacagctgccagggaactgatggaatcggaaatctttcccacactcttctggttcgcatcattgatctcccatgcagaattaatcttctcgctcatatccccaagtgcctccaccgcggtgtttgcactgtctgaactctttgcggatgcttctttgatacgctccacgaattcactcatgttggctgtcatgttctgggtctgttctgcaagtttacggatctcttccgcaactactgcaaatccttttccggcttctcctgcacgggctgcctcgatggatgcattcagtgccagcagattggtctggctggaaatggaattgatcccttcaatgacttcattcatattactgataatgtcaaaaagcttctccatattctgtttcatggtacttgattcactgatcgtcttatcggacagatcgcggatagccgtcagctcctgctgtccctcttcgatgtttttgtaaatcgctgcagattcttccgatgcagacaatatcgtattggtcagttcctcatgctggttggaaacctcccctgccacacgcgaactttctgacgcagacttcgtagcgtcctccgatgcctgtgcgatctcctgtgaaacagattccatcttggaattataatcttttaaggcatccacaacctctgcgatctgtaacgatgcggatgcattctttgccaggatctgaccgaactggctgcgtccgttcaccagacgggtatacagttgctgtatctccggatcttttgaataatctacatttttcaattccagaacggcctgcagaccggctctgtctgtcttttttccaaatgccatattatatacttcctctctgttgtaacatacaaatctctgtatcttatgccttttattctgaactaaaatatgtttaaagtcaacatatttctatcataattcagatattttttgacacttttgctgctacacacaggttgccatgcgaacaataacactattcttacaacttcaggttttccacacaagaaatacacttgccacaattccggcagtggttgcaaaaagggctcccggaagtgtatatcttgtcttttttacttttaccgacataaaataaaccgacatggtataaaaaatggtctctgtgctgctgagcataaccgatgccgcacgtcccagcatcgaatctgcaccatgtgttttgtagatatccagtaaaagtcccgttgctgcagaggaagaaaacatttttaccacagcaaccgggatcagctcggtcggaaatcctgtcgccgccattaattttccaagccacccggaaataaaatccaaaaaacccgaagcccgcaaaatacctactgctgccatcagtccgattagcgtcggcataatctccactgctgtgcggattccgctttttgccccttccaggaaatcctcatatacatgctgccggtgcatcaggccatttcccacaatgagcaataccagaatcggaatgactgcctcggataagtacagaatcaaattcatttttccaccctcccaaatgcctgccggagcttgatgaaaatgacagctgccaacgtggaaatactagtggcaatgatggccggtcctacaattgcagccggacttacggctccatactggctgcgatatgcaatgatattcacaggtatcagctgcagggaagaaatattaatgataagaaaatcacacatcgcgtctgtcgcctgatttgacattttctgcagccgctttaactctttcatggcagaaattcctgccggtgttgccgcccagcccagccccagaaaatttgacaccatattcgttgccatatatctggctgctgtggaattttccggaactgacggaaacaaaaaacgtagtatcggtcccattgcagatgccgcacggtttaccatcccccctttttccgcaatcttcataagtcctacccagaatgccatggcacctgtcattgtcagacaaaggcttaccgcttcctttgccgaagcaagtgcctggtcggtcactgctccaagatttccagtcattgcagcatacaccaccccgacaagaatcattccaccccataaatagttcatccgcgcctcctgtttgcgttcttaaatcattgtatgggctttgcttttttcatattccttttgcaattaccggataaacccaaaagggaaggcatagcccaggctttctctgcataaattttcttaagttttcttacaggagtttctggtatgaaacatcttttgaaaaaacaccggatgctttccgtgggtatttttctggctgcggtactctccattatttatgcagccatcctttcccctgccggaaaaaataccggttctttttctgaattttgtaccacgctttttcgcgaagagatgaaatccaacaccatgaatctgcactttacgctaaaagatccaaaagctgccggcattgactcttatgagatcacgcttggcagtctgtccggtgacagtcctcataaccaggccagacagctcaaaaaactttcggaagaactcaaaaaatattctcaccgctctctcaaaggaaaagaccgcctgacctgccggctgctttccgattatatttcacgccagcagaaccttgctgcctatccctattacgatgaacctctgaccccttccggtggtgtcacctcacagctgcctgtgcttctggcagagtatactttccgcaataccagagatattaaagattatctcggactgttgtcgcagatggatacttattttttagggattttagattatgaacaaaagaaagccgatgcaggacttttcatgtccgatgaagcctgcttaaaagtcattgaagggtgtgaagttttcaccgaacatcccgatgacaattttctgatcgatacgttttccaaccggttaaatgccatggatgggcttacggatacccaaaagaatgcttatttgaagcaacattccaaagttctgagtgatcatgtccttccggcttacagccagatgatcaaaggacttaccatgctgctgggacggggacataacaactgggggctttgtaactttccggaaggaaaagcctattatgaggcggtcgtgtctgcggatacgggctgtgatgacagtgtggaagatctgttttcccagattgccaaagcccggcgggaagatctcacgttctgtcagaatcttttggaaaaaaatccgaaacttgcttcccagtctccgaaacccgatgctgccttgaaagaggaaaatgccatgctttcccggctgcaaaaagaaatccttactgacttcccggcaccaccacagacagacgtggaaatctgccacgttgatccggcactcagtgagtacttggctcccgccttttatattacggctccgattgatgatatttcacataaccggatctacataaacgatgctaaaaatgatacggatatctattactttacaacgcttgcgcatgaaggatatcccggtcatctgtaccagaccatctgcacctcctcctatggtgctccggaagtcctctccctcctcaactatccgggttacaccgaaggctgggcaacctacacggaaatgcagtctttctattatgccggacttgatccggatctcgcctccctgttacagcacaaccaggccgcaacactcagcctctatgccactgcggatatcgggattcattattttggatgggaaaaagaaaaaatcgccgcattctggagcgaatacggcgtagatgatactgccacggtaaaaagaatcacggatctgatcctcgaagaaccgggaaactacctaaaatattatgttggctatctgaaattccgccagatgcgtgaacagcttgcgctcgaaaacaaaagcttttcggtgtctgcatttcacgaagcaatccttcgcaccggtccttcgcctttttccgttctcgaagaaaccgtgcgggatcagttaaaataaagtccattgatcttttttattttaacagtgcctgatagatatcgcgcttgctgaccccacggtcttttgcgacacgtttcatggcttccttgcggtcaatcccctgggactcataatgcgccatgtgttcctccagggaaagtgcttcccatccggcctgttcctcctttttcatctcttcgcgggaacggccggcaatgataagcacatactccccacgtggctcattgacttcataataggatagactgtctgccagtgtcatctgcagtttttcctcgtgacgcttcgtcagttcccggcagatggtaagcctgcggtctccgccgagggtatcgtgcagttcctgcagagtcctcaccagatgatgaggtgcctcataaataataatcgtgcgcgtctctgtttttaactcctcaagtaccgcctgatgctctttcttatctttcgggagaaaagcctcgaatgcaaaccggcgtgtcggaagtcctgacatggtcagtgctgtaatgcaggcggctgcgcccggcagcgaagtgaccggaatgccttcttcatagcagatgcgcacaatatcctcccccggatcggaaatgcccggtgtccctgcatctgtgatcaaagcaatatttttgccctcccgcatttttgcaacaagctggtaggctttttcaattttgttgtattcgtgatagcttgtcatcggcgtcttaatctcgaaatggttgagcagccgaatggagtttctcgtatcctctgccgcaatcagatccacctctttgagtgtccgcagtacgcggtacgtaatatcctcaagattgccgatcggggtggcacacagataaagtgtgccggttttatgttgttccatgggagttccttcctcttcgtttctatacaggcgattgcgaaacaggtacgaacgttatgcgctgcaccggtttcgcaattgcctgtatttaagaataggatgaaactatcatacttgtcaagtcgcaaaattataactgactccgcaccgcacaccgggcaatgcaatcattaatcgaatactccctttcccattgaaaaatatcgtgctaaaatatatctggaagtaagaaaagaggatttcatttatgcacgataacacacagcatttatataacaatttggacttacgaaagctgctgatcccgattattgtggaacaactgctttcttctttaatggggaccgccgataccatgatggtcagcaatgtcggctctgccgcaatttctgccgtttccctggtggattccatcaatattcttgtcattcaggcactgtctgccttatctgccgggggcgcgatcctgtgctcccagtatctcggcagccagaacaaaaaaaatgccaaccgttctgctcggcaggttttgtttgtcatggtcattctgtctgtaactttatccgttttctgtctgatattccgtgatccgctgcttcatgtaatctttgggaaagtagaacgcgatgtcatgaccaattcccggatttatttcttctttactctgttatcgtttccgtttatcggactgtacgatgccggtgcttcgattatgcgctcccagaacaacagccgcaatccgatgatcatctcggttatttccaattttatgaacattggcggaaatgcgattttgatctttgtacttggcatgggcgtcgaaggtgcggcgatatccactctggtatcacgtattttctgtgccatcgtcgttatctggcagctgcgcaatgacaatgccccgatctgtatccgcaattatttttccatccgccccgactggtatctgattaaaaaaattctgtttatcggaattccgtccggtattgaaaacagtatgttccagttcggtaaacttgccatccagtctacggtttccacacttggaaccgtagcgattgccgcgcaggcaatgaccaatattctggaaaacttaaacggtattgctgccataggtatcggaatcggactgatgaccgtggtcggtcagtgcctgggtgcagggcgcaaagatgaggccatctattatattaagaaattgtcctggctgtcagaggcagtcatcatcgcaagctgcctgctcgtttttgcactgaccaaaccgattaccatgcttgccggaatggaacctgccagcgcaaaactgtgctttttcatgataagcttcatcacgatcgtaaagccagtttcctgggtactttcctttatcccaccctatggcatgcgcgctgcaggtgacgtaaaattctccatgatcacctcctgctgcaccatgtggctgtgccgggtaagcctgtgcatttatctctgccgggtatggggattcggcccgattgctgtctggatcggtatgttttccgactggacgctgcgcgcgatcattttctccatccgtttccactcccggaaatggttaaatcatcgcgtcattgaaaaatgatgatattccgttttgtgatcttcctttgcatatttttcttcgatgctgtttttcattttatcgtatgcgacagccattctgtttacatgctggtcaaaactgtctgattttacggcatctgcattaccatctttttcatatgcttctgacacttcactctcaaagcggttcacgtagtcctgataactgaccgaggatagctggttgtaactgtccattcctgcctgcgacaaaaaaagattgtccgcgtacgatttcatctccgtcccgttcatctgctcctgcagccgtgccgctgcctctttccttgctttttcactttttgctttctgtttttcatggattttatcagcccaggtgtctttcttatccttgtccagtttggtgctgtttcgcgtctgcccgccatcatcatcttccgcgattgaccagccactgacactgccatccgcattgatgaccgttcctgccgcttttatatggtagcccatacctccctggctcatttttccgctgtataccagctgcgcacaatcataaatcaaagcctcatattccacacgtttgtcgggatcattttgcatctgcaccagaatattcggtgcgatctgaatattgtttgtgcctttctgtgaaaagttctgtgtgtttgttgtaaaattcactcccggataccggtccgaaagcgcttttagcgatacggacgtgccgctgccggattttgccttcgcatatgtcagtgccgtttccgacacccaactgtttcctacttttactgccataatcttatctctccttttcaccccaaaatatattatctgtaaaacagtttgttaatttttgcactccagtccgcaccaatccccagatccaccgggtaatcctgaaacgaggaaactttctgccgctgcatatttttttcatccactgcattgtgccacgattccattactttcttctgcagttcatctataaaaccttccccgtaatttccaccatgaaaggtctcgtcgatctctgccataacttttgccgatgcagccgcaaattccgctctggagttgtacgccttgtttaaagcgtcgatacgatcctgttttgtttcctccacaagtgttccgtcctcctgtctgatccaggtcgggtcccggtccggatcggaaaattcttcatcaatacggtcataaatgacctgataggctttcgccatgacggtaagaaattcctcctgcgaccgcgaatgatcaccaagtccattttctttctggatctggtctgcaacttccccgagttcacagttgaacatacttgccgtgtcgatattgtttaccgtattcagttccttataaagttcctcttttggatttacacctgtgtgggatatattttcattgtcttttgtgtattctcgccagtccttcgcctttgcaagaccttcgtcggaaattgttacagtatccactccggttgcttcttttactgattttccaggtgtacttgccgtgtatttctgcgtatccagcaaatttggtatttcctgtcttttgtagtgataacgtcctgcgtaaatttgtgaactagaaatattcagtgccattttttcctcccatcatgctctctgtgaatatgtcaatattttcttcgtatatatctgtcacgtttcttcgttcctgcgcccgttttaatgctgctttctgttgtcttttcatcagttctttcattcttttctgacgcttactccaccatgattcgtcctttttcccagactttttcgggctttccgtattcattggaatcccttctccatgatgttcctcgatcgatgcgtcgaatttttctacgttcagaaatgatgcctgaaacggaaagtgcaccgaacggttttctatcgtatagccaagcacccaggcttcatactccgggtcatttttcatctgctcccagccatcttcggtgattgaccacatttccttacagtttgcctgtgaactgtcaaaagagacgccatctatcaggttcttaaaaaaagctttatactcatccattgtcatatcgcttctggatatctcatcgccaccgcagtttttcatatagtttttgcctgcctggacctgctggttcacatgagatgcggaatccggatgcttctgcttatactctttgacaacatttttgtattccttttgcgtctgcttctcacaagtattctcattcgaaacatccttcttttgggatacgcctgtttttatatttgtataattataacccatagctgctgttgcacttatattcatttcacaaccatctcctttgccatattttactaatgtttatatcgccctttttctttttttcttccaatcaaatgtaacgaatcgcccttttcatgtaacgaaaaaatcagcgggcatattgtacccgctgatttgctgatttctgtttcttatctgcaatctatattcatcaattcacgcaactgaaaagcatttcatttacatttttgctgcatcatcttattttgaaaacaccgcatcatttttggaaagaaggtatacacaatactgattcatgctgattccttctctctgggaatgttctgccaacgatctgtgcagacttcgtggaattctcaatttgaattgcccggaataatcctccagactatctggctcatgaatctctacaccatcttctaatgcagcttcaagccatgccttttttgcatctaacgcattttctacggcactttctacagtttctccacaggtaatgcaccctggcagatccggataagaaaccacaaatccaccctcatccttatcttctataatttccatacgataggacattgccatataatcattcagcgtcttcatcattctccgcctcgctttctacaatctgccttaccatttctacatatacttttttgatcggttcatgttttggtattgtgataggcgcacatccctgctttctgaacgtgtaatgactgcttccacttcttggtgcattcatttcgtacccgcagctttccaatactttccgtaactcatcaaaccggaggtcttttgataaattgcatatacgtgttatgagtttatcccattttgacattgttataccctcctgcttatattatatatggtgtcgtatatggtgtcaattattctattcgttcctgaagcataaccgccagttcaaactcattctcccgaacggtaacttccgtttttccataatatttttccgcacacacttcaatattccgaagccccagtccatgatttttggaatccggttttgtcgtgagcaatctgccatcgctccggcttctgacaagtttcccgtcaaaactgtttttaacgataataaaaaacatattctggcgccggtacgcactcagttcgataaattttctgccctctttttgccgcctgcaggcctctaacgcattattcaaagcattgtttatgataatgctcaggtcaaaagcatccatattcatactggaagggaaaagaaagtccgcctgaaacgcaatgtcatagttttttgccagctgcacatatctttgcataatgacatcggtcaccggattgccggtattgtatttcatatccagctgttccacggatgcctgcagggaatccagatactgccggaacgcagtggggtttcctgtttcctcctgcatcaatgcctccatatccgcgatataatttttcatgtcatgtttcatcccgcggattccggcataaaggttttcgatatctccgatatgctgctccatttcccggatccattcctgataaatactgatttcgattttctggttgctttcaacgattagtttgtgcagcatttttgcggtaaaaataatcatcacaatacacaacagggaagtacatggaaccataagattcatctcaggccggctgtcaaacagcgaatgaatatcattgtcctccatcgagaacatcatgctgcggatcatcagacataacaatagtccggtcacgcttggaaataacacaaaaatcaattgtgaattttcatagttttctttcatttcaaggtactttttcatccagacaatgatcctgtatgtgaagacaagaagcaccagaacgtagctcagattccagaacatttcaattccggaattcacttcaaaaaacatggtttctccatacatctgcctgtccagaaataaatattgattcagatctaccagctttgtaagcagccacagaaaaagaggataaatggcaaattttaagagttccattacggaataaaaggtcacaacatagtaaatgattttgagtctgctttcgttgaacaaaaaaatgcctgccacacagataaccagcatgctgatcagcaccggcaggatactctggcggctgttattcatgaccatgcttttcccatagagcagactttttataaagacagaatagtgcagaaaaatctggactgccacatactgtcccagcagtatcgcagcactatgatattttttgaatggaaaatgtggctgtgcttctttcaacaaagtaaccagcaacattccctgcacaaaatagcttatgatatcgaaaacgttgtacacaatatctctcattgcagtttatgcctttctcagataattcatataggcagttacaaaatcgttatatttttgttttgccagaaacactctatcgccatttttcagttcaatattggcattgtcatagcggacaacttcctgcagattcaccaaaaatccccggtgcgatcggaaaaaatgatctcccagtttctgctctaacacttccattttttcgtaaaaactgtaggtttcttccttcatgtttttcgtgtgcagaacgatttttctcgcttcattttccgcataaataatattgttgaccggtatcttaatgtaattgccatccattcggataatgagcggctgcgtattcttttcctttttgatctgactgatcgccttgtccatgacttccatgaatttctgttcatcgaccggctttaagagataatgaaatgcccctacatcatagccttcaaacacatattcctttaaggcagtcacaaaaataatgatcacatcggaggtttccctgattttctttgcgacttccatgccgtttggtttgccactgtccggcttccgattcagggaaatatcaagcagaataatatcatatacggtcggatcggataacaactcttccccatttgcaaagacatggacctgtgcatccgtgcatttctctgtcagtttttttaggtaatctctaattggctgttcatcatcacatattgcaattttcagcatgctttcattattcaaaatctacgacctctttcttaccataaagaaatgtccgacaacagattctgaatggatacattattttcctgcccattctttacaaacttatcccgaaacatcgcccctgctttgatcacattctctgaaaaatgttctggcagattttccggattttcttttttcttatcctgcgccgctaaaaactgctgagccctctgacttgaatttttccagacagaacttcttctaatcgcatcctcaagcatctgtgcggactgatcctgctgctttgttctcccttccaatgatttcgcatgatcttcaaaagattccgtaagtttttgcaatgcttccctgcttatattgtatcggcgcctatcgtatatttctttaacatctattatttgaatctctttagcctgcagatctggttgtatgatccttattgattttattttaaaatcggatcgtttatgatctggacttagtttcatgtaacgaaatgtcttttttatgtaacgaatttttttgcacaagctcaatagtcacccgatatttattatttttagaccataagccataaaaacagccatgcatattccccaaaatacacatggctgatttactctacaaaagcaaatttcacagataccgtcccgtaacactatcttcatttcccacaatctcctccggtgtcccagttgcaatcacccggccgccgtcatctccgccgcccggccccatatcaatgatataatcggcgttgcagatcacatcgagatcgtgctcaatgaccagcaccgtcgccccattgtcaaccagcgcatcaaacacgctaagcagcgtctgcacatccagcggatgcagcccgatcgtcggctcatcaaacacaaacaccgaatccgactgtccttttcccatttcgctggcaagtttcagccgctgtgcctctccgccggaaaggctcggcgtttcctcgcccagcgtcagatagcccagtcccagatttttgagcacttccagccgctgatgcacaacctttaaatccgcggttgcctgcaaagcggtatttacatccatctccatcaattccggcagggaatagcggtttccctgtttgttttcatagccgatctcccatgcctcttttgcataccgggaaccattgcactctggacacggcacatccacatccggcagaaactgcacatcgaggctgatctgtccggttccgtcacagaccggacactttaattttccggtattataggaaaaatcgcccgccttgtatttccggtttttcgcatccgcggtccgggcaaaaatcttccggagttcgtcgtgtacattcgcataggttgcgaccgtggaacggacattgattccaatcggtgacgcatcgatcagcttcacatgggcgatgccctctgccgaaagatctttcacatgtttcggcagatgctctccgttcagctgcgcctgcagccccggaatcaggctttcgagaaccatcgtggtctttccggaaccggataccccggtcaccacggtaagcctgcccttagggatgtccacctccagcggctttaccgtatggatgcggtcggtggaaagatgcagttttccaagggcaaacagttcctccggtgcgatcggctgacggatgcgcagatcctttgtctttgcgagaaatggtccgatcatggagtttttattggcaatgatctgtggaatactgccctctgcgatcacatatccaccgcccgctccggcttccggtcccatctcaatcacccagtccgcctccgataaaatctgcgtatcgtgatcgaccaaaagcactgagtttccatctttgatcagatcatgcatcacggcattcagtcccacgatatttgacgggtgcagaccgatcgacggctcatcgagcacatacaacacgcctgtcgtgcggttccgcaccgcccgcgcaagctgcatgcgctgccgttccccggttgaaagcgttgccgccgcccggtcgagggaaagataagaaagtcccagatccatgagcctttttgcaacggtcttaaacgactcgcagatggattccgccatcggacgcatctctttcggcagggattccggcacatgcgccacccattcgaccagctctttcagcgtcattttgcaggcttccgccagtccgatcccacaaagtttcggtgcacgggctgcctccgacagcctgcttccgccgcactccgggcagacttcctccttcaaaaacttctccacccgcttcatgcccttttcgtcttttacttttgccagagcattttctacggtgtataccgcattgtaataggtaaaatccagctctcctgcctgattggatttctttgctttgtaaaaaatatgctttttctccgccggaccgtgatagacgatatccttttcttcatcggtcagatctttaaacggaatgtcggtgcgcacgcccatctcccggcagacgtcagtcattaacgaccacatcaggctgttccacggtgcaaccgcaccctcatcaatactgatcgaatcgtccggtacaagcgaatccagatccaccgtccggacacttcccgtaccgccacacttcgggcaggctccctgtgaattaaaggcaagctgctccgcactcggcgcatggacacgttcgccgcactccggacagatgatctcctgttctgccgcaactttcagtgtcggcggaacataatgcccgttcgggcaccggtgcgacgcgagccgcgaatacatcagccgcaggctgtttaacagttcggttcccgttccaaacgtgctgcggatgcccggaatgcccggacgctgatgcagggccagcgccgccgggacatacagcacttcgtcgacctgtgcttttgccgctctggtcatgcgccttctggtgtaagtcgaaagcgactccagataccgtctggagccttctgcatacaacacgccaagtgctaacgacgattttccggagccggatacgcctgcaatcccgacaatctgatgcagagggacatttacatttacgttttttaagttgtggacacacgcgccccttacttctatgtattttggttcgttgtgactgttttccataaagacattacccgtgtatgaattatcttgcgtactttcttcctcaattatacagaaaaacatgcgaaattccaatagtattccagacagaaaaaagccgatgcatcccagacgatgcaccggtttttccgtttactatataaaatactcccttgtatcggctgttaagtcagccacccttttaagctttcagatccagtgaacggatctcctgccgaacctttaaaatcatggacgggctgacagaaagctcatcatatcccatactaagaaatgtctcggtcagtgtcgtgtcggccccaagctcgccacagataccaacccagcagccacccttatgaccgttgtccacaatcatcttaagcatcttaaggattgccggatgatgggaatcataaatgttgtcaagctttggattctgccggtcgatcgccagtgtatactgtgtcagatcattcgttccgacagagaagaaatccacttcctgtgccagttcttcggacatcatgacagctgccggagtctcgatcataataccaagctcgacatccttgtacggaatcttttcctcatccagttcttttttcacttcctcgatgatcttctttatggtctgtacctctgtgacagaaatgatcatcgggaacatgatggcgatggttccgtaatagcttgcccgatacagtgcacgaagctgtgtcttgaatacctcgcggcggtcaaggcagatacggatcgcacggtaacccattgccggattatcttctttgtcgagtccgaaataatccacctgcttgtccgcaccgatatcgagtgtacggatgatgactttctttcctgccattgcctcggctaccttgcggtatgctgcaaactgttcttcctcggttggataatccctgctctccagataaaggaattcgcttcggaacagtccgatgccgccggcatcatttgccagtaccgatgccacatccccaacgcttccgatatttgcatacaggttgatctttgttccgtcctttgtgatattctccttgcccttgagttcctgcagcagacgctttttctcttcatcctctgctttcttcttctggtaagcttccataacggagaccggtggatcaatgatgatcctgccttcgtatccatcgacgatacccatttttccatcgacatcttccggaaaatcgacaccgatcagtgccgggatattcatggtacgggccagaatcgcggtatgggaattggtggaaccgtgacgggtgacaaaggaaagcaccttcgatttatcaagctgtacggtctcacttggtgccagatcatcggcaagtaaaatcaccggctcatcggcattcaggccatttcctccgttgccctgcaggatggaaactacgcggtttgacacatccctgacatcggctgcacgctcacgcatataatcatcatccattgccgcaaacatctcggaaaatgtatctccggtcgttgccacggcatattcggcattcacctgctggccttcaatcatatttgtgatggattcgatataatcaaggtcattcagcatcatctgatgtacttcaaagattgctgcattgacttcaccgacttcttttaatgccttatcataaagcccggcaagctgctgttttgcggtatctttggcatcttcaaaccgttttacctcttttgcggtatctgcgattttctcccgctttacctgattttctgatttgcggtatatggcaaggcggccgatggccaccccgctgtatacgcttttaccctgaattgtcatagcgtcacctcatccttttgctgattcattctccgtaaacggttgccggaacggtttcttacagtttctcctctaagaatttgccaagtgctgcgattgcttcctcttcctgatctccatccgtctttaatacaatttcctgtccgcatttaacaccaagacccataactccgaggattctctttgcgtctacttccttgccatccttgctgatggttactttacatggatatgcagcggctgcttttaccagctcgcctgccggtcttgcgtggattccctgctcgtctttgatggtataagtaaattctttcatgatcattctccttttcaaattttgtttctttatcaatgttactgtttacagatttttctgtccgtttattcagcatcctttttgatcagtccgagcaatacggctgtaatgaaagagccgactgcccatgcaaggatgtataaaagcggatgtcctacggttgcaaatacgaagattccaccgtgaggagccatcagtgtgcacttaaacagtgcggataaaaatcctgcaactccggcaccaattaaggtacatggaattacgtgaagcggatctgctgctgcaaacgggatcgcaccctcgctgatgaaggaagcacccattacaaagttggataccttggatccacgttcttcctttgtaaatttcttcgggaagaactggcaggcaagcgcgattccgatcggaggaaccataccaccgaccatgatcgctgccatggcaatgtaacatgcctgaacagccgggtcgcctggctgtgcacctttttcaatcatctggcttgcagttgccagtacgccggtaccaaatacataagcggctttgttgattggaccacccatgtcgatcgccatcattgctccaaggatcagtccgagtacggtgatgtatcccgcatcagagattgcggtcagtccgttgctcagtccggtattgatcagtccgatcaatgggttaaagatgaagcacattaaaatactgataattaaaattccaagcaacggataaatcagagtcggcttgattccgtctaaggaagccggcagttttgaaaacgcttttttcaggaacagtacaataaatccggcaaggaatccggctaaaattccgccaaggaaaccggaaacggtgttaccgccgttagcaccctggaatgcaaagtctgcgataaatttctggaaaccggttgtggaatccgcccagttgtaaccggtgactaatgcgttaccactcgaggctaacaaaccgcccgtaaaaccaactgcaagtcccggccggtctgcgatcgagtatgcaatgtaacctgcaagcaccggaaccatcagtcccattgccagtcctccggcatacttgaagaatgccgataacggcgtacaggaaccgaatgccgatccaccggttgcaccatagcccatcagggtatcgatcagaaatgcaatcgctgtcatgatgccgccgccgataacgaacggaagcatgtgggataccccactcatcaggtgtgtgtaaatcatgtgtgcggtagaaccaccctctgctttttcttcttttctgctgccctctgccgcatggtagacaggtgcatccccggccacggcacggtttaacagctgctctgccttgttgatgccgtctgcaaccttgcacccaatgactttctttccatcgaagcggtccatcggaactttggtgtcagctgcaacgatgattgcggtcgctcctgcgatctcttcatcggtaagcacatgcttggctccgccggaacctctggtctctaccttaatcgtgattcccatctcagctgcatgcttctctaagctttccgctgccatataagtatgtgcgattccggtcgggcatccggttacggcaagtaccttgtattttgccccagtttcgtcttctttttcatcctcatcttttgcgctttccgcatcatcgatgacttttaagaattcgtctacggtctttgcatttttcagtccgttggtaaaattctcatccatcagaagtacggaaagtttgctgagcacctccagatgtacattatcctcggtgtttggagctgcaatcagaaacagtaaattgacaggtgctccatctaacgcgtcaaactctacgccatcctttactaccatagctgccagtcccggtgctttcacagcatctgacttgcagtgtgggatcgcaattccctctccaattccggttgttccttcttcttctcttgcaaaaacccccttgcggtaagtttccacatcgcggatttttccgctttttgccatgagatcaaccattttgtttaaaacatcctgttttccggctgcagaaccgttcagttcaatgctctcggctgcaagcaaatctctgattctcatagtataccctccttaaaataattttttatttgcatccatcaatgcaagtacttccttttttgttgccaattcttcggaaaaagcactagcacttccggtatatacaccatagcggaacgcatctgcatagctgccaccatttaaatatccatatataaaaccagccaccatggaatctccggcgcctaccgaattcacaagttttcctttcggtgcctcagcccggaactcctgaccgtcttccgtcacaaggacggccccatcacctgccatggaaacaagaacatttcttgcacctttttcctgcatgcgttttgcatatgttacaacatcatccttatcattgattaccgtgtggaaaatctctcccagctcatgattgtttggtttgatcaaaaacggatgataagcaagtacgttcatcagcagatctctggtcgcatctactacaatattgagtttcttgttctgcagatgttccatgatatccatatacatggattccggcattgtgtccgggatgcttccggcaagtaccagtgtatcgccatcctgcaatgcatccagttttccgtaaagcttccggatatcttctgatgcaatctttggtccctgtccgttgatttccgtctcggtctgtgcccggagttttacgttgatacgggacaatccttcggtaacgtgaataaaatctgcggtaacacctttctcctgaagaagccgtgtgatggcatctccggtaaatcctgccataaatccaagtgctgtgctttcttccccgagatttttcagtaccattgaaacattgattcctttcccacccggaaaaataatttccttgctggtacggttgaccacaccggtcataaagttgtccacatttacaatgtaatcaatggatgggttaaatgttacggtatagatcattctttcacctccacaatatttttgtattttttaagtgccggcttgtacagctccgttgttaagatggttgcctgttcaaaatcagcaaatttcacactggaaagctggtcaaacttgctggcatctgccagaatatagcagcgtttgcaattcttcatggaatatttctttaccatggcttccttgatctccggggtggaatatcctttgctgacgctgattctgttcgttccccagaatcctttggtaaagttatacttggaaagcatctccatggcttcttccccgacgatcgcctctgtctgggatttgaattcgcctcccagcagataaacacggcagcccttttccgccagaagctttgcatggctgatggcatttgtcacaaacaccgcctgtgtctccttaataaaagggatcatcgcctcggtggatgttccggcatccagataaacaaaatcatccgggcggatgagggatgctgcatactttgcaattgcattcttttgttccgcattcatcgtcttacggtttctgacatcctcatcatgtgtactcacactcggccgtctggcgattgcaccgccatgcaccttggtcagaagaccattctcatccattgtaattaagtcccggcggacggttgattctgaagcgtcaagtgcagtcataagttcctgtattgtggcacttccctccgcttctattatggacagtatccttgaaaatcgttcttctgcaagcatatgcctcactcctttgttttctttttcgttcacaatctttcaaaatcgttcatttgacgattcttattatagttacattttctgtcatcgtcaatcactttccgtcaaaatcattcacaaaaacagaactgggattttgtgcataatgtcatttaatatagtggctcgaaaggacagggcatggttcagacagaggcaatccctgtcctttctatcgtttcattatcgtataaactatcatgtagtaagcacaaaaatacaatttgttctacaaaaagaacagcatacttattgagagtatgtgtattatttgctacaatatccccggaatatgacaaaacaggtttttctgtgagtttcttggtattatcttatagaaatgcagaaaattttattttacaatgatccattacaaacacaaggaggaattatcatgagaggcgtcgaaacccgaattcaggaaatccgtcacaaaatttttacagaagtggcccgtatggcttatcataccgaatggcctgtaaaggaacgtatggaagaacttccatataagattattccgggagaaaccggaaatttcagaaacgatgtatttttggagcgtgcaattgtaggcgaacgcctgcgtctggcaatgggcctgccaaaccgcagtgctgcagagcatgccccggtatccgatggcattgaagctgctgaccaggcagaaacttactatactccgcctctcattaatgtcattaaatttgcctgcaatgcctgtcccacaaaacgtgtgcatgtaacggacggctgtcagggatgtctggcacacccttgtatggaggtctgtccaaaggatgccgtatccttagaccgtaccaccggcagatctatcattgaccaggagaaatgtatcaagtgcggccgctgtgcaagtgtctgctcctataacgccattatcattcaggaacgtccatgtgccaaagcgtgcggtatggatgccattacttcagatgaaaacggcaaagccaatatcgattatgacaagtgtgtttcctgcggtcagtgtctggtaaactgtccgttcggcgccattgctgacaaatcccagattttccagaccatccgtgccatccagtccggtgaaaaggtttatgcagctgtcgctcctgcatttgtcggtcagttcggaccaaaagttacccctggcaagctgcgtgctgccatgaaagaactcgggtttgcagacgtttttgaggtagcaatcggtgcggatctgtgcgcaaagcaggaagcagaagatttcttaaaagaagtgccggatgaacttccattcatggcaacttcctgctgtccggcatggtctgtcatggcaaagaaattattcccggatcacgccaactgtatttccatggcactgactccgatgacattaactgcacgtcttatcaaaaagcataacccaaatgcgaaggttgtctttattggaccatgtgcggctaaaaaactcgaagcaatgcgccgcagcgtccgcagtgaagtagatttcgtgctcacctttgaagaaatggccggtatttttgatgcaaaacatgtggatctggaaaacatggaagaagatccggatggtgtaagtgacgcttccaccgatggaagaaactttgccgttgccggtggcgttgctcaggctgtcgtagatgtcatcaaacgggatcatccggaacaggagatcaaggtggcaaatgccgaaggattaaaggaatgccgtcagcttttaaagcttgccacattaggcaaatatccgggctatctgcttgaaggcatggcctgtccgggcggatgtgtcgccggtgccggaaccatgcaggcaatcaagaaatcccagacagctgtcggtctgtatgccaagaaagcaaaccatcagttctcaagcgaaaccgaatacatcaaagaactggataaactggtggattaagtatctgccatgtaaaaaagccctgcgctttcggaaattccgaaaacgcagggctttttgtctgttattttattctacttcaattccagtatcaaaggtccatttccactgaccaaaggaagatgtgtatctgctggttcctgcaatatcattgtcaatcatgattccgctgcatgtagaatgaatccgccagtacctactgtttccatacttatgcacaatcgtgcggccactgtaactatacttatctcctgcagatctcttaatcgttccctttgcatagacaccaatatcttccagataatcctttaccgcttccatcgaagaaaattctccgaaatatatggctatatgggaggaagaaccgcccttgccataaacaacaacatctccaagttccaactgggaaaggcttttcccactgctttttcttccaatagacttctttgtgccggaattccactgaatcgcaccctttgttgcaacccctgttgtatacgaaatactcgatccgcttacccagtctctggtacaatgtgctccaacactgagatttttcagtgcagtccctttccgtcccttactctccagacgattcagggctgcccgtgtgtatccactgcagtcacagcggattccatcaaccacactgccataactctttcccaaaaatcccttacacaatgttttccggtaattatcctgtgccacaaccgcggtatgattcttcgatgctgcttctgccggtgctgcagtaccccctactacaactgccgccagcaaaatacctgcgatcagctttctgccccatgtaaacttaaacttcaatgcacttcctccgatttgttacaactttgttacttaactataacatattttaacaataagtaaaacctttttcaagaaaaatgtgcaaaaaagtttcatttttatctcattttttatgcttttttaatatttttgggtctcaatctcctggaaatcatttttcatatcatacgaaataagtgaaaaatcatcccgttccacatgaagcacataaaaacggtcacccgaagaaagtcccctcatctgttctgcaccggtccacgtatccattttctgctgtgttctctttaaggaaattttctttacaaaagacgttccatcccactgaaacagcatatacctgttataattggttttggtccaggtctctgtcgcaaatccgaccagtccacgtccggtatctacaaatgcacacttgtaattctctgcggcactgcagaaatcttcgtttatcgtcacagaatccaaaatcctgaggtttatcggatcggagatatcaaacattgtgagttttacccctgtcttctcgcttgtcttagcattggtttcatagccgatgccaagcaacagtccatctccaaacgggtgcagataatcggaatatcctgtcatcttcacatttcccagcggcttcggatgtgccggatcggaaatatctactgcaaacaacgggtcggtattatgataagtaatgaaatatgctatatttcccagataccgtgccgcataaatctcttctccctttgcaatattttccagcaatccctcttttttcaggtccgcatccagcagatacaagcggttttcggataaagaattttgggaatctgttgtcagaatacgaagttctcccccactttccgaaatagcaaacgtatcccggatcgccccctttacggttgtttctgcaattgctgaaaacattccattcttataagaaaacttggcgatctttgtcttttctccacgctcatattccatctgatacagatagattgcatccgttcccatataaacctgtcgtccgctgtcgagaagcaccatatggtctgcagccttcgatggctctttaagatttacagatgccataatgacttctgttgtcccattcttctgcacataaaaacatccggcatctgcttttttcccggcaatctccggaatgacctgagccttccagttctttccgtctctggacacccaacggtcagtaaacagataaataaaatttccaaccttacgggaactctggtatgctccatccattttcatggttgcacttaataccggatttacgcgttcggaaatgtcatacgtcaaaagaactgtactcacatttccgtccggttcataagcgatatctttgtaacatccgataaaaccggaatcattgtcagcctccgtgctgtcggactgaatctcctcctgttgtgtttcccatccctgcttgataacatacagccggtcattatccacgtatagctgcaaaaggatgtcattttccgtcagttccggccgtatttccgacagcttacgcatatttttgtcccgaatatccacaatggtcacccggtcatcattcagcacatacagataatttccgtcatttttgacgatgtccccctcatccacaccgtttacctgcaaattggtgtcggaatgggtaccggatgactcttttttcgcctcggcagaaccggtatcttccacgaaaaacgaatcatccactgtgccttctgccaactccttttgtgaattggattttttctgtaccgctgcatatacatcctggtaactttttgccagagtaaatgcaccgatttgttctttcttttctgtatcctgcgtactgtcgaccgtttctgttacggaaagagcagcctttttcggttgcgcatcatcggttccatacttattccatccataggttccgaccgcaatcaccagcactgcaactgccgcagcaattccggcaaatctccggtaatgtctgtgttctttcctgcctgcggatgtccggtttttccgctcctccagcatctgctgcacagccccgggtgtcagagtatccggcacggtaatctgctctgcggatctgtctattttctctttccattcttccaggttctgttcctgcatattctcacctcaatcccttcagctgtttttccatccgctgcaacgcccgatgttctctcgaccgcacagtattctcattcattgcaagaatctgtgcaatctcccgcgtcttatatccaccgaagacatgcattcccacaatcatgcggtcctcctcatccatcgtaagaaatgcacgccggacttctatatattcctcacgggtatcaccccatacatagccgtcccagccaccgttttcttccgtcagttcttctccccgttgatagtattcccgcattttctgtttacacatatttgccacgatacgatacatccaggcggaaaaagcatcttccttccgcaatttcccgatattttcaaatgcttccatcacagcggcactgaccacatcctccgcatcctgtgtatttccaagcgtatacagcgcaaactgatacagcctcttataaattgtcccatacaattcggcaaacgctgcggtgtccccgcgctttgccctttttactaataaacgttcatccatggaaggccctcctatctatacagtgtatcggaggtgtatttttgttgcaagaaaataaaaaaagcggtaaacttcatcagttcaccgcaatttccaattgaaatcttttttctatcatcttaagatagcgttcgtcataacttgcagccacaagcattggtgcatatgcatcccttccactaatccgaaacatatagggaaattctccaaaatgctccagatactgctctgcaaaatccaaaattccccgctggatttccccgattccctctggattaaaatcatatctgccaaattccagtgtaatatccaccgtttccagataaatgctttccttttctgtctgatatcttccattatgaaatccctgaaacgaaggtgtcagggaagaaagcaacagttcccagaacacgttataatccttatttggatcatgctttttcaacagatcacggttcatctgtccggaatacagataggccaccagcctgccatcctgcaggaatggatcggacgcatcaggctgggcattatgaatggtatttgtccccgcaacaatccctgtgatccggcaatccatcccccataccttttccaccagatgggaaagcgcgagcgcaccgcttcccgcccagccaatatcaaccgctgctacgtttttacatccatacagaatctcccggtaatacttttctgctgcgacctgctgttcctcataatgtgtcatcacccgctcccattttgcctcaataaaccgtcggagcagatatgcatttttgtctgtcagctcatcctctgcccgcaaatcaataaatttctgctttctgccggcacccgattttcgttcccatacatcccatatttcctgccagtctgaaagttccggaagcaattgttccaattccatggaacgcagagcctcccctatcgtaaccttttgattgaccttgtgataaatgaatctccggaaaaaatcgtgcttatcctcatctgccatcagttttgtggccgctttccgtgaccagtagacatataccgtccggtcatcgggatataatttctggtaaactctgcggagaatatctccatcccgcgccagaaacagtaactgatcgagataatgctgctcataatattcatgaataaaatggcaataccccacaacaaacaatccaccatacacatatccatattcgtaatctatactgaatttttctgatccattgtacaaatgattggataccagcccccggtatgccccgccgatcatcgatgacatatccatcggacggtacagtaacacatttttatttacattctgatagggcagaatatccagcccgctcgcctttgccattttctgatcactgtgtggattgtcaccgatatgtacaatacgcgcaccggaaaaatcgcggatcacacggtggaacagatctccaccggctttattctctccatactcattggagatgtaaatacgctcggctcccgtatatccggttttctgcagtattctctcaatacaggagcgtggaagatacatgtccgaaacaatgatcatgcgctttcccagtttctgcagacgtttccatacctgcagcatatacggatttgcataacagagtttttcctcggtctcacactccagccgcattccttcttctgcattcaggccggtatcttcctccagattttcccatatatcctgtaacgacacttccgtatgtccgtttttttgtctgcatttcatccgggcatcccattctgcccacacacgtaaattcttaaaatcgaggaaatcaaatttttctccaatcagataaaacacatctgtcggagaagaaaacgggcgaaaaatcaatgtatcaaaaatatcaaatgagatcacatcgtaatctttgatttttctgacaaaatcctctacagaaagaatccctgcatctttctggtgtccttcggattcactggtttttatcatcaatttgtgtttttcataaatttccatctctggaattcttccgagaaatctacagaacaatacataatatgcgaaatttatccacaacaaatatgcccaggaaaacattctgcgcataccggttgcatcatcatgtaccttatgataccggtatgaaattcccggatgcctgtttaccaaaaaactgtatacttcacttctcatatcttaaaaaccttttcaaatgagttgtaacttacttgcttctatatctttaattttataaaacaaattattgtatctacgttactcgtatgttatgatacatatacctatttgttattctgtttttcttttttcagtattataaaaacaacaatctttttatttttccaaatattatacacacaacagtataggaggatattacatggccaatacacgccatacttaccatcttcattcgaaagagattgaagaaattattcgtaacaacgggctgcctgaagaaatttccacggaaacgcaactttgggatttaattataaaaaaagcaacttacagttctcccaaactcctgtttccgctcatctatgaaatctatgggaaaaaatatcccgaagattcctctgttgttccactttccacagagtattctgtagaacgctcggatacaaaagaaatttcgaccattaaggctgacctcacattctgtgtaaatgaatcggatatttaccactttgaatgtgaaattacatacaatggacttatcacaatccgtatgtttgagtatgatgttcatgcgtccctgaattatcggcccgacaccaaaaatccgcagcttctgctcgaattcccgaactctgccgttcttttcctgcagggaacgaaaaagatcccggattatctaagctgtctgatccggtttcaggatggcagtactcacgaataccgcgttccaaccgtaaaggtgcagtcctataccctcgaagaaatcaaagagaaacatttgtgtatgctcatcccgtttcttccaatccggttccgccgccacatcccttctgaccgcaagatgcagtcagcaaaatcccctgataaacgacatgatcttgagaaaaaagtacagaaatccaaagaagaattgacttcttttctgcaggaaactatacttatcttagatcaggaaatcgcagagggatttttaacggaaactgacaaaaaacttattttaatgcttttgcaaaagtccatgctccgcatttcttaccgtaacagaaatttatgtcaggaggtgtataatatgacagaacctgtactgaaacttccaaccgatgaattattcgaagttatccatgaacgcgatgcactgaaaagagcctgttccaaaaaggattccgagattgctgaccgggatgcccgacttgctgaccaggatgccaaacttgctgaccaggacgccaaacttgctgaatatagacgcagatacggtgatctgtaaataatacagcatttcacacaactgctccgattaaccggagcagttgtttttgtgtaccatgaatttctttttcgcccggtgctccacaagccgccagcatatcgcattctttaccttgcagctttttgccttctgcagttttttgtgatacttccccgcatcaatccgcttcaaccaccccatgcctttcaggaaatcattcattgcaaggatcacataatactccgaaagccagtctccttttacatgaaacgtcgtcatcttatccttccactgccgcaaaagctgcaaaggctccggcaaaaaaccatagagctgattcacaaacagcgggtttcgcgtgtcataatactgcatgagaggtgtcatccgcttgtcgtatgtttcatgccacacctgcactccttcaataatgattggcttttttccgcatcgcagaccatattccacatcatcacagtgaatgaaaaacggaagtacatcattttcctgtacaaatacatatggaaaacagcaaaaccaccagccaccgtaatccgcatccgcgtcgtagatcactctgccctgtgtgtatgccgttttccggacatcgcgcatgaactccacatgcgaaaccattccccggtcccacttctccgccgccgtgtactggatatatggatcatccatgcaaaacatgcgtcccgctaccgggcggttcctgtccgcctccccgaccccggataaaaaatcaaacagcagataaaagctgctgatgtcaaaggcaacatcatcatccataaaaatcacatgggtaaatccctcatttcgtttacggatctcctcaattcctctctgaaatccaccggaacctccggtattcctgttataaatacaatgcacatacagactctccggcaattgcaaactgctgccattgtccaccacaaaaatatgaagccttccgtaatactgcgggttgtccggattgaaaaaatccgatgcctgcaaaagtgacagatttctgtgaataaattcttcacgctggaatgtgcagatattcaatgcaattttcacttcgtttttcatgatcactgcctcttaaactttttcaatgtttatatatcaataattgagcatattctcatcaagcagaaaatcgaagatattcataacaagaaccccgtcctcattatagtaaggccccggcgaatccttcgtaataatgatttttttgaaggcatcccctgtcagcatcaaagaacgttgttcctgttccatctttgcctgatcaggcatcgcataagccgactgaatatagtaacgctttgatcctttgttgcagacaaaatcaatttccagctgcttgcgcacactgtttcccttttcattggtactgttaatttcaataactcccacatcgacattgaatccccggagttttaattcgttaaaaataacgttttccatagtatgcgtttcttccaactggcggaaattgagccgtgcattgcgaagtcccatatccgtaaaataatattttacgggtgtatcaatatattttttccctttgatatcataccgtatcgcgctgtcaatcaaaaaagaatcacacagataatcaatgtagtttttaattgtgccggcactgatattcttctgcttcatactcttaaatgtcgctgacagctttgtcggatttgtgagtgaaccgatggcagaagaaagaatatttaaaagttcctccaattccgcacggttccggattttatgtctgcctacaatatctgaaatataagtttcctcgaacagcgcctttaaaaatgtaattttttcttccggcgttttaaaattcaggacaagcggaagcccgccatataccacatactcccgccagccattctcctttgtccccggataaacagacataaactctgcaaaactgagcgggtacatatgaacttcatcccccctgccgcgaaattccgtaattacatccttggaaagaaaatgtgcattgcttcctgtcacataaatatccacatttttcatacggatcagactgttaagcacagcttcaaattcatccagaagctgaacctcatccaacaaaacataatacatatcctcatcctgaatctgttctttcatatacggatacaaaacatccggatcacgaaatttcttattttcaaaagagtcaaaggcaatttctataatatgccgcggattcactccctctgccagcagatgatctttaaacagattaaaaagcagatatgattttccacaacgccgaatcccggttaccaccttaatcaatccgttgtgtttcttgctgatgagcttattcaaatatatatttctcttaatttccatacaatgcgcctccttctattggttacttttgcagattcctgcgcttttattcaatagaattatagcatagttttgtatgttatccaatctctattagttacttttgcagattcctgcgcttttaatcaatacatttgatttctggcacattccagagcacttgcaatcacggcatccatatcataatatttgtattcccctaagcgacctccaaaaatgatattttcctctttctctgccagcgctttatacttttggtaaagttccccgttcttcttatcattaaccgggtaatatggctcatcccccggcttccactccgaagaatattccttactgataatggtctttggcaagtcatttccattttcatcttttccaaactcaaaccatttgtgttcaatgatccttgtccacggtgtttctttatctgtataattgaccgccgcatttccctgaaagttcggcacatcaagaatctcattttcaaaacgtaccgaacggtattccagatttcccaatgcatagtcaaaataggcatcgatggctccggtataaacaactttttccgccatcgcattccattttgccttatcttccagatagtcctcgtttaaccggacttcaataccttccagcaaattctctaccagttttgtgtaaccaccgatcggaattccctgatacaatgcattgaaataattattatcaaacgtaagcctgaccggaagacgcttgataatgaatgccggaagctctttacagtcacgtccccactgtttttcggtataaccctttactagtttttcatagatgtcacgaccaacaagagaaattgcctgttcttccaggttctgcggttctccggtgatctccttcttctgctcctcaatctttgcagcagcttcctccggtgtgactacaccccacatcttgttgaaggtatacatattaaaaggcatggaatacaattcccctttgtagtttgcaaccggtgaattcgtaaaccggttgaacgttgcaaaacggtttacataattccatacctctgtgttgtttgtatggaaaatatgggcaccgtatttgtggaaattgataccctctactttttctgtgtaaacatttccggcaatgtttgggcgcttgtctattacaagcactttctttccggcatcggctgcctgtctggcaaatacagatccgaacagaccggatcctactactaaataatcgtacttcatgttccttctcctttactcttgcattatttttcgatatgcatctgcgacttcacttcccagcatcatgtttgcgattttataagtacgtcccgtatcacataatgcattcagatcagcccgtgcacgtctcaaatactcttctttgtattcttccttaattttagaaagcgcgtatctgtgtgtctggatcttgcacatctgtaaattatcaattaatctctggtctttcgtacttccaatagactgattcagatgttcaaatatatcaaaatgaacatataaccgctcatcatctgctgcaacatcctgcccttctctttctaaacggtaataatacagatactccgggatcattacgacagattttgcatatgcaaatgtttctaccttaaacggcagatcatcaaacctctttaaatccgtataaaaccttatattatttttttcaagaaattctttacggtaaattccacgccaaattgccacccggcaataagtaatcagtcccattattttttgttcatcataacatccatctaaatatggataccataatgaatcctcagccggttttacttttcctgtgttttcataatattcattgtatccgcacaggctaatatcaaaattgccacacaatgctacttttaacaatttccggtacatattctcgtccacgaaatcatccggatcgataaaacctatgtatctgcccgatgcattttccaaaccagcctgacgcgccgacgcacaaccaccattttctttttcaatcagccggatacgtgcatcctgttccatccatcttttgataatagcaaccgattcatctttcgagccatcactgacgaaaataaattccacgtaatccgctttccatgccgtaacacttttcagacatttttctatatacggagcaacattatataccggaaaaatgacactaagttcgatcgccgactgcctgtctttcttccagtcaagcatttgtggcttcttgtctttccgccatattttcagattgacttcctcacaaaattccttacactgttcccatatacggaatgcacttattttttcctctgtaacagaacctgtcagatactttggatgaaatttcaaaatcggtaacagtgcttcactgatacaattaattgcacaaaatgcccatgcttcatccattccctgaaatttataatagggcacaaatttaagttcctgaggcaattcaaataattcatgcgctgcatcattttgtattctatcttccagagtccctatatctttctctgctaaggaacacacaatataacatctttttagtttcgtgtatttgaaaatttcttcgagcctttccagcccacagtttcccattaacactgcaacattgcaaatatccaaatgggatgccaaaaataattccaactcctccataccttagaaccccttatagcgaatttttttaagtaataattttgcagtatatttaaatccactgtcttttatacactgaattccaccactaattatattcttctttcttcctccatggattgaccaataccgatacaaattttttctatcttcgtaattgattaactgaaaataagtatcgccccttaaacactccagtaatcccatgcgcttatctttttcgctctgctccaattgaaactccccactatatgcagatatcatttcttctggaatttcagcaaatattttatgtaacccttctaaaagaggatgaatatactccatatttgtcatatctatcatccacaaagcataattaaagatcatatttaagacagccgcctgttcgtttttcccgaactcattttttcccacaacatccaatacatccgcaaaaacacttaagatatctaatcttccaattccacgcccggcggttatctgcccggtattatttgtccggtaaataaatccagtattcggcaatgcgacaatgctttttgccagatgaaccaattgcacatgcggtcgaatatcttcccatttcacaccttccgggaaagaaaacgcacactccctcaaaaattctgtccggtaaattttgcgattcgcgtttacctctaacaaataaagttccggacacttttgcgcgtacagattcttaaatgcatttccagactgcacttcaaaaattttctcgtataatggcttgtccatccagtcttctaagagatgagaagcctcattatagcatttgggcaatgtgaatatcatgtccgggacaaaatccagacaatccagacaatccttcactttttccacaaatcgtatatcctgccagtcatcactatccagaaaacagacatatggtgtatctacaagatttaatcctatatttctggcagctcctaagcctttgttttcctgatatacatatgtcatacgtccatttgcttttgagacatactgtttacatatatcggccgtgccgtctgtcgatccatcgtctatgattatgaccttaaaatcatttatcgtttgtccgatcagactgtctaaacattgttgaatgtatggctgcacattgtaagccggaacaacaattgttaaaagtacattattttgtatgctaatttttatcaccccaactatcaaattaattgtttgtaacttaaaattgtccctttatatccaaaattacgcagtttcctctctactgcctcgtcattaacatcacatataatcatatttcggcatatcagcaaatttatatcatcacgtcgtacaagtggaatgccctcccatcgtgaatgttttgtataattttctacaatatacaatatgttgattttccattttttaaaccaggaaatatatacatcagttatttgtgacctgccataaagagcacattccctgatattatttttttctaaaaactgtcttattctttctctgttgccttccatcagcagtcgtttaaaatatttctcgtagttgagcatcctatccgctacttgcttttcactcctgtttgattcaagtgtttttcgtaaaatttccccatatttattttgtaatattttttcataagatacttttaattgttcaagtgctaccttttcatctacattgccatctgtattctgcgtaatgatatctaccgccttcaatgcataatcataatactcttgaacatagtgtaaaagcgctctcccccatttatggttaatatctcctacaacattatccgggaattcaataatatggcagccttttaaatattctttaacataatcaaaacacaatttcatccgatcattaaatgctgttgccacctcatgttttgctggagatacatccattctatttccatctgtctgaaattctactgctttaatttcaaataaaataatatgctgccggtcatatagagtgagtattttttcacaatattcttttaaatatccatatagttcctttttatccagatctaatatatcaataatattataatcttttggaactatgccacttttaatatactttagcaataaatctttgtagctttcggtaaaataaccttcagtttgaggaaaatataacaggctctttctggcttcagcacaatccataataaaataatcagattttcctccatcaaaatattcaaatacctgtttgtttaattcaagtatttgacattttttgatgaagttagcttttccctcaaaaagatcactttttatttcttcaccaatttgataacgtggcgacttggtaactactgaaacaggacttggtatttgtacatatttcttaattacatatccaccatctccttcatgcaaactaaaagtatctcttaatacgcaacaccctaaaatgtctaatgttgtatttttcatattttttattagacaattaaaaataattatctttcctttccattgatttttattattatctcaatccttttatacaactatcctctgctttgattgcattacttgcctcaaaactatattatgaaatcaaatctttgctaattcttcttacaatattcaatatatctatcaatttttttaggcaaccaatcgtctaatttcataggtgtgtattttaacaaatcacattttgacaggtccatagtaagctctggatgttttgtaaaaggaaatggttctgcattatcattgtatcttgcttttatgcctgtttgttcttccacatattcaatgacttctttcatcgaaatacttccctgtgaagcaaaatttacaacccctttaaaattattttttgacaaataataaagaaattgtgcttcatccgaactctcaacaaaattaaattgactttcgagatttgtttcattgattgcttcttcattaattatagctgaaacatattttaaaattctatttgcaaaatcatcattaaaatcatccttctctgacattacaaatggaatacgaacaattgcataatttatatttgaatacttattagataataatacttcggcattatattttccttttgaataccatcctttactaccaaatttaatattactttcaaattttttattcagtagaggcaaatcatcttcatttacattacatcctgtacattttctttctacgtaaacgccaaacgaagagacatatatgtatctatttgttttcacatttgctaatacccaatcaacactttgcggaacaaatgcagaacaatcaaaaataacatcataaaaatcgccctttaaagcattttttgtttgttcttcatttaatctatcaaatagtaattttttaactgatgcaaattcatcttcaatcttgtgctttcctcgtaccgcaattgttacatcatctccattagcaatacacaacgccgtaagttttgatgacattctaccagttccacctaatattaaaacttttctctttgttattttatcttcccgcgtcattgcatagtattctgattttccacaatctgtgattgattctgtagtcattatcctactccatgcacaattcttacgtactaacctcgccggattaccactgattgtacagttattaggaaactgtccttttactacactttttgcgccaataagactacctgttccaatattagttccatgcataataaatgcaccttttccaacccatacatgttcgccaattataatagcgttacgatgtggcaactgcttttcataaacagaatttatattttggccggttgtaacatcaaaaatagaatgaccatcccctgcccacatatctatatcatgtgaaaacatacagtctcttccaattatgattttctttccagaatttgcatgtaattcaatattactttcaaaggtacattcttcaccaatgtgaatagatgaagtatactcactattatatagtctatacaaaacgtttgttaaacgacagtttcttttaacaataacttctgattttccattaaatcctcttgtcacaaaacgattttctgcattaattctattttcacgttcaatttcaatataagcatttgctgtcaaatcaaaagtaagattttgtacccctgtaactttatccccgataataatatgattattacatcctctgaaaattacacttttaattttccctgtgtatccctcaattgtatttccatatgcatcttcataccttcccattgcacaatcataatcctttatcacaattggattaggaaaacgacaaataaaatcttcaatctcattatatccatattcctgtaagattttatatgtttcagaagcttttttaggatccaatgctaccacataaatttcgccactatgtcctttcagatttgaaaatggatatattgtttcattatttactctgcctgctgtctttgcaacagaatacgaaactttcaaaccaaaaaaatcttttaggactttttcaaatttttctgattcaatccaagttacaatctttcgtcccttacttttttctgctgctgtttttgcaagataaaaatactcatgtaattcctctggaagaacctttaataactctaatttaacatatttatacaattcattatgataacatcctaacgttaatgatttaaaatctaatttatcaaagtatttaaagaagtcattccggttcttatgaagacgatatggtttttgaataatatgatttccactaattgcaaccgataatggttcctcctttactttctccattcttggctttaacttttcaaagaatttctccgctttctgattatttattaaaacaacggatgttcctttcttgtcataaacttcctcatcgtatcttgcaatcccccaaaaatctccaattgtcaaatctccctgtcgaggaagtttattagatgcacacttttcacacgttgtattttttgcaatagattttaaatatgcaatgaaatacagatctgattccaatggttttgaatactttgtctcatctgtaaaatatgcatttacacccgcatgccacccccacggttctttttccttaaactccaatctttttagttgtttcccgttcaatatatctttatgatacttttcaaacaccttaaacgaagtgattccatgacataataaatccattgtatataatgtgtcataatttttccctaaataagaatacagtcccgcaatttgacaaggcatacctgtaaataaaaccaatttaccattttttaacaattctttaatgtcagaaaaaattctacttgcatagctttgtatatatttcgagccacgtaaacgtcccaattcatttttgtcgtttatgataatatgctcaactgtaaaatcttttttataagcagctccacaaacatatcccccttgttctaaaatatattctgctgctactgtaaacattcctcctgatgaacttattttccttatttcatcagatgccatcatcgcataacattttggagctatattattgttatatgttggattctgtgaagtacacttctttaaacataagccacaattaatacatttgtttctatttacatttggaacccaaaatccctctgtattcttgcataattttattgcatttttcggacataacgtctcacatgctccacatccagaacaatttttatcattaacaatctttaataccgttttttcatcgcaagttccatctgctggttttggaatgatattcttatttattaaatttacctttccgataatattcctttctttcaactctatctcattttttttaggtaaattgattacatcatataaccatttgtaacaacgttttcgttctacctccattatattctctacaacatcataattaatggattctaataattgtggatttgtcaaaacatcctttggatttgtaattaaatgatcctcaaatttaaataattgggctaacgatgtaaatcttgaaaaccctcttcttttatttgccatcgcaataaaattttttttaaaaataagtgcaaaagaagcaccatgacatgaatccgttaaaataaattttgcatttttcaaataatataaccagtcttccacctgcaaattttctatgcaatttggaagatccattaatttcttatttttttcaaaaagccatggcagtccatccagcaaattaattacttttacatttccaaattctttctgtaaatgcaaaatagcctctcttttttctggagtaggatccaaaatatatgatactataaattctccttcttctttctgcgaagatttttctattaatgcatcataaatctttggatctgcaagaaatacaggatcaagcacctgttctgcttttatcccataatcttctttacataaacgtactccatctgcctctcttgttccaattccatcaaaaaaactcatatattcagaaattataaaacgctcatctaccggagcaaaatcaatactatgaccaaatgatatagcatatgcaatcttctttttttcttcagcagcaaagtcaagataaaacgcttttccaaaatttttacttatcccataattccaaacctgatccgacccaattataaaagtatcacataaattatttaattcatgcagttcccctaatttatattgtttacttatattataatgttcctgtccaaatcttcgggaatgtgtttcctttaattctgcatcatcagctcttaaaaccggtttatcaatcataagtaccgatttccccatagatgtaactacttggttcaacgcataataagttgcaatacttccgtaattgcaaccactccataccccaaatattccgacatcataatgctcttttttatttgaaactccactcataattttgtactcctatttattgagataactctcccaaaattcaactcctgtaatctgattctttgcattctgatatttttgggttacctcctgtaactctcttctataatccctcttaatcttccgataccgcttcattaatcgaagatattctttccttgaacgatacctcaatacacctgtctgattatgtggatttactgctaatactacatcatgcctgtattgcttctcaggtatatcaaaccagtcatacgccacaacagccggctcatgattcatcataaatttaggcagaagctgccaattatgcgtcttcatatatcttttcatcttgtgttctgaaaaaattttacccttataaaactgatagatatcattataatccactttgatctttggaaaattctggcgaacatcaactaatggctgtacccttgcagcttgctttttcattatcatttcaccttctggcttcataataaattctggaccttttaagaaatcctctattgcatccaataacaaatcacaaccaacataattgtatcgaccaagctctttgtcaaatatgtttttgattctttctacataatccacgtctggtgtaacatcactggttgcctgaataatcagactgttcctatgaacctgataaaactccattggcatattaaatttagtgacaaaccccatatgccatatacagattccattcattgtaataaattttgcatgattagcaatagaaaactccacgtcatcaccacggataaataatggtaacgctaaccgttctaaactcaactttgttcgtggaatgcagcaataccaccatcctgcataattattcggctgatcctgatagatcttttcatttaaaataactgaatttgccagatgcatctccatagacggctttcgcggtccaaaggttccatcctcgctgacaaatcccacgtcttcgtgctggacattcattcgctcatagtacaacatcgcgccactgataaaatgttctttgtactctgatttcacacagcacaatatgttgtatgtccggataagactctctggaagaatttttacatcatcatccataagaagtgcatgtgttgccacaaacttctcatctttgagtgtctcgatcattcctctggtataaccacctgatccaccaacatttggattcttataaatatggattttttcactgttccattcattttcattcagcgttcttccgttatcaattactctcacaaagatatgatctgcaagttcttcatctgaataaataatttcattttccagtaatcttaaatttctggtaataaaatcttcttttttaaaggtaacggttacaagggaaagattgacttcattgaactggtctacatttatctcagctacatatccaccctcatatataaatacatcatcatatgcaaaaatctgaaaggaaacaacctgacattttgtatccattggaatggataataggattgtttctttttctgaaagttcataataattttcagaaataacttccttttcaattgcatttccattcatataatgaccaaacaactggatgccaaactttccccgcgcagtcaaccgcagggctggctgttttatatttgtatacaacttccatttttcaattgaaaacgcattaaagtatgtaaaaaactccgcatgttcctcttcttccagacaatatgctgactccagtacgttatgtgaaaatttatctccccggtaaaacatccaccaatgctgctctaaatcctgttttggaaataaaagattttgtaattttatgatcttatccatttttcttctcctgctacatcaatttctctttcagccactgtacggatttcatccgaaacacatctaatttactatcgaccataccgtatctgattggttttctgcaaagatatttcttttccctcacatcatcctctatataaatcacacgctccatcaagcctaattcgtctaatgtagacaaacattcatatgcatcattctcctgtctcgatacaactgcgataaatggctttttatatacaattgccaaatggcagatcactgcggaatctgttatgatcagtgaacttttttcaatcgccctaagatattcatctactgatttgtcatttctattggtctgatcttttgaataatcaatcacacggtactttaatgtttcttctgccatttctgccactttttgtttttggttatctcttttttcaaaaaaagtggaaataaataaaccatcaactccatatgcatccaaatacggatatttttccaataacaacaccggatgacatactttttccgcagacatgccaaattccatattcaggatttccaacgtattccggtctgctgctgcaattccgttaaatctctgtaacgcaaaaaagactgcatttttcggtcccagcggaaattcacatttcctgccaaaacttggagcatatgcaatcctttttacagtatctttttcctgactaaaaaaacacgactctatggtttcctgtttaccatattcccatctctttgtacttcctgtcacaacagcatgaagctgatccctaaattcctgttccgtaccatatgcatgactttccgacaatttacagcaataagattctatatattccgatatttttgtctgtccacattttttgtcatcatatacaacaaaataatctcccaatttttcaattgttttataaagtgcatatgttgataatatctgtcccagattggtattatcgttgattgtatccaataaaatatttttcatattcccttttactcctttattgttcttacagctttgcgacaatattttctatttttttattaaaataaactgtaccggccagataacatccggctgcatatagtcccaggatcacccacatcttccagtccggaaatgcacactccatcatacatttccgggcaattgtgataacaatataaagtggatttatcagcataaagttttgcatcgttggcgataaccgggttatatgataaaaaatagcagatgaatacattagaaaaagggtaaaaattttataaaaatatgtaatatccgcaaaggttacattaataactgcaagtatctttccaattcctgtcatcatgacaagcaatagcaaaatatcggggataaataacagccatgtcacactcggcggaatccggtaaagcgcaagtacaaatgcataaatcatcagagaaaacagaaaattgcggaaagccacaaaaattttttcaagaatgtaaatatttttacttaaccgtgtttttattaaaaagtttttgttcccaaacaatgcatttaaacataaagttgtccctgatgtaaacaacccataaatggttgtccccgtcagaacatacaacgggaatccgcccgcaattccagttcctaacatttttccaaatataagaaccataactatcatattaataagcggattgatcacttcccataattctcccataaaagtcgacgataaacttcttcttttatcccgcttcaccaactgatcaatcacaaaccagttttgcttcagtctctctatcctgctctgcactataatctctccaccacttcattttcacattttcgaaataccaaaactccaaccagaaacattgcaatcgtccatccaaacatccggccgatatacaccgcttccggtctttgtccatacaccacgcactgccgcatcacgtaaataaatacatacagtggattgcgttcgatcacccagcgcacaccatccgacatccagtctatggagtaaaacatcgccacaaaaaaacgtaaaataaacataaaattagaatatatatttctggcatcccgctgaaacacgaaccagatcgacaccagatatgaaacgccagttgtgaaaatcaataacaaaatcagtaccactggaatcatcagataatacaccgtcacatttgcccgataacatgccagcaccagtgcaaacggtatacaccccagcaggaaattcacaaatgccgtcagcacacgggacaacacaaacaattcccgcggcagcttcgactttatcagcagattcctgttatctttcaacgtagtaagcgacgtctgtgtcgccgtcgcaaaaaactcaaacataagaaatcccacgaaataatacgccggatacttatcaattcctttattaaaaatggtcgagaacaataccacaaccaatgccatacgcatcaacggatacacacagctccacagaatccccagaaaacttctggcatattttcgtttcaattctcttttggtcagttcccagagcacaaaccaatattgccgaatactcatgcttctgctcctttttcttttcccatgcgataatatgcgcccagcacacccaggaaaatggtgtaaagtacataggtcagaatataaggtccggtaaacaagccctgccccagatatccaaccagtgctgcaagaactgctgccttttccggttttcgttctttgcctttcgtgtacatcacaaatgggagaacatacatcaggagcctgcatgctgcgccaaatacccccatggtaaccagatattccaacagatcgttgtgagcagtacaatacagccagttccactctacataaaagtcggctttcgcaatctgtgcctgtgtaactgtatccaaaagtgccggtccgacacccataagtttctgccagagcgtgccatcgcaaaatcccataaaggagaaataccagatggaaccacggaaattaaataatttcagattgtaattgtagatcacatagaataccacaccgataactccgactatgatcagccagatccatactttactgaacacacgctccacacatgtatcaatctttgtccgtattttttccggaaaaaccgtccccagcaggaacagcaaaatgattaccattccaaaaatccccggaaccagatacagacggtgtgccaaaagcagcttggacacactgtcggtatcaattgcacgcggagtgcacggatgtttccacaaaacttctgcaattccaccggctatcgcaaacaaaattccattgatcgcaagatttttcagacgattgactttgcagagtgaataccatacaacaaataatgctgcaatgccaattcctatgtaagtcgtatttgtcagcgtgataaacagactgaaatatgccgcaagcaaaagcagatagataaaaaaccgtgcaaaccagtttttcgtaaacagcgatgccagcataaaaaatggaataatgatcgacaaatatcccgcccagaagtttacattacctatagtagaaataaatatgttgtactgcagcggaatctcatcgtgcatgatgaggaaatcataccccagccggtctatgataccgattgcaagcactgcggcggttccgaaatacagatatacccagagatctccctttccgctgtagcatctggaaatgataaaataaacaataacactacagacaatcatctgtgttcccacatcccacgcattttctccggagatggaatttccgatgtcggcactatataccgttgacacaattgcaagtatgccaaatagcagcatcacaacatccagtgcgctgattttttgaagctgtgtcctcatattttttgaaaattgatggtttttaatcacaagcatcagactgatgcacaaactgactgcaataactacaaataaaatccgcgaaaacagccaataaatatcccttttatcgtttaaaatattatagtaattatccgaatagtacagtggcaataatgtaaacatcaataccatgaacattttcacggcttcttctcttacttttttcaaaatatatcccctattgtcaagatataggagtcagtatttcctgactcctatggtaaactcacatttcataaaaactattttgttttaacttttgttgtagatgtccacttggaatatactttcttaccattcttgtccagcttgtaagcacgaacacgaacatagtaagtagtcttatccttcaggctctttacggtgtagcttgtcttctttgttgtcttagactttgtagtcttctttgtaaatttcttggatgtagaatactgtacttcgtatcctgctgctccggcaactttcttgatggttacctttacagaatcattctttgctgcaacagtagctttggcaggtttctttacagtaacctcctgctccggtgttgcgtctgtagctgtagtctctgcagttgttgctgcaaatactggtgttgcagcaggtgctacagttgttgcaagtacagctgcggccagtaatgcagctgctaatttcttcattttcatgacaataagtctcctttcctctgaaaaatgtgagttatatataaaaaatctgtatacagattttttaccatattaatatatttactcgctgtattggctgcgataggctctgcacacaattctcggatccccgatcatgcgcatatttccctgttcaatccagacaactttcgtacagttatcgaggatcgtctgcatcccgtgtgaaaccataaggacggtggagccgccgtggatcagttctttgatccttgcgagactctttttccggaagaattcatctcccacagataacacctcatccaaaatcaaaatttctgccgcacctgccaccgttgcgatggaaaagcccagcctggaaaccataccggaagaaaaattctttactttttcttccatgaatccctctaattccgcaaaatctacgatttcctgataatgttcgtcgataaatgctttggagtaaccaatgattgctccatttaaatacacgttttcctttgcggacagttcaaaatcaaacccggtaccaagcgtaagaagctgaaccttcctctgatccacaaccactcttccggaggttggattgagagcaccggatacaatctttaacagggttgattttccggaaccattcgttccgatcacccctacaatttctccacgatatacgttaaagttaatatgatttaatgcatacagttctttgtatgacatctgttttcgaagggtctgtatcagatattccttaatacctgacacattattggttgcaatccgaaaccgcatagtaagatcctctacacagataaccggtggctcagatctttgctctttttccttttcaaggtatggcaggatctgtaccgaccactcttttgcttcctgttctttctgttcccggaactttttgttttcttccgtgtaatcaacaaccggacgttgtttttctattttttcatacaccatttgtaagatgcaggcacttacggccatgacaccaactgtttcaaacattgcaatcctctttatctattttgctttaaggctctgccttaaatgtgttacatactttgccattcttgcggatctcagatttgaagaaatatgttttcccgcattgacgattgtcccttcaatccacccgctttcatggattaccttttttgacaaccccaacatgatacataattttgaaagaattctcaagtctttaatttctctctgcgtcaggcgattggcgatacagcgcatatgttcatcggacagatcatccgaaaacagctgcataccatagtattttgcttcccatcgatttggtctggacatgatggtttcatacaactttcctgctatatctttctgacatagcatggctgctttatgttccggctgcttcgacagatgatccataaacatccggagtaactcattgtttttctttagctgctctgtgtttggattctctacttgcgagaataccggaatatatcgtccggcttcacagcaataagcttttatcatcggacaaggttcactgtacatcacttcaaaaagacagttactgaatcctgccttttttctgatattcccctttggcatgaaataatatgcctcatatctgcaattgtttcggtttaccggatactcatataatccaaaatagtatcctgtcaaagtaattccgggtttttcctgtgccaaaagtgtctgcaggcttttctggatggttcctacccatccactgtcaacaattgcataacggacattgtcaagcaggccttcctgccgcagatatccaatggtagtctcatatgctgcgtctgacttctcataaatcctctccagcaaatgtgtcgttccttccgcacaacatttttttacccgttctcttaaattgaaaatttctttccgatttaaggttgcatgtaacgatctctgataattgatttccctgcatacagcaatcatctcttcttcactgagtgccgcacggtttaagatttgatagaaactgatatcaatccccgaaagaaatatgcggtccagacacgcatccccgagaagatgatattccggaatacgcaaagcataacgggatactcgcagataacagatttctatgggaatatgtaaatattccaccattttctttgcaacaagatacatcggatatgcatctcttgccagaaaatacagtcttttctgtctgtttttttgtgcctcttccaaaacccatgctacatactgtaccagtgccggtgcccataaggtgacatatatctgatcctccggtgcacacagctgcttcaggcactcctccgcagcaccggacagaaaagtattctgttttaacagcgtacggtacgtttccattcgcggttgtatcgttgcctgatgtttcataagtctgccatacgctccttttttctcacgatcatgctggacggtacaaatctgctgaccatcggacgaaaaatatagagccagcctttcggccagaggattccaagaccacgaaatccttcgtaacgcacctgaccttcatgaaaccggtttttccatgaccgattgtgataattttcccggtctacccggtaatcaagcaggcacttctggatgttataacctttgtagcccagtccgaacaaacgcataaacaattcataatcctcgcatcgcgcagtcttttttccttcatcgtacccagccacctttttgaacaggctggcacggtacatgacggttggatgaatatacggcgaatatttcaggtaatcgtccgtacccggctcctccgggcggactccctctccccatatgcctctgtcatcaaccagcttgcagtttgttccgcaccacatatattcgggatggtctttcaaaaaactgatttcttcttcaaatcgttttggatgggaaatatcatcggcatccatccgtgcaaggtattttccccttgcactggcaatgcattgatttaacgcataccccagtccatgattggctttcgaaccaatgacgcggattcttgaatctttactttccagctctttcatatatgtgtttacttttttgatagaagatccatcgttgtatattaaaaattcaaaattccgataggtctgttgcaatacagaatttactgccttttcaaaaacctcaagatcctgttgattgtaaactcccatgatcaccgatatcatgggtctctcccggtcattttctatagtaacttccggtaccttcggcagtttctggtagatctgactcatttttgccgcagactcatggagtgaaaattttttaactgtattctgcgcccttgcggcatatcgttgtctttgttctttattttcatataaagaaagaattgcttttgcaaactcgtctgcagaagcagcattacaaaccagcccgttctcctgatctatgagatattctctggttccccgattatctgctgcaattaatggaattccactcgccattgcttctaatcctgccattcccataccttcacgcaaagacggaaatacagaaatatccgcggttctccatatttttggcatatcattccgatatccctgcaagaaaacccggtcggataacccgtactttttaatctctgtttcaagattttttctattgggaccttctccgcaaatgctatagtagatgtccggacgtgcaagttttgcaattgcttcaatcactactctgtgatttttgtttttattgatttcacctgcagatacaatgtgaaatgcatgctccggaattccgagattttttcttaaggtatcccgttcatgaacttcatcttcttttaatggataaaatttttcaagatctacaccaactcccggaatcagtgctgctcccccatcttttttataatgaaatttatctgctctcgtataatcctcatgatttatggtaatgataatatctgaaaattttgccagaactttttccgccggataataaaacaaccagttttttaccggtgctccctgaaaaaagtgaaatccatgtgctgtgtaaaccacaaatggctttcttttactgagtacggctgcaagacgccccaataccccaccatttggattatgacaatggacaacactgatcgcttcgcggtctataatccgtataagttcccgcaatgcccatatattcttttttattttaaatggatttttttcaatactgatatgatgcagtacaacccccatattccggagtgtctcatctttgacctcatagattggtacaccaaaatttgttgcgtaatgaacctgatatcctttttcctgaagaagtctgacattatttaattcgaactgcgacaaaaaaccactggttgtggttataatcaatgccttgttcatccctttttatccctgatctttcgtaaaccaaaaaacattttccacttttctgatactcatcataagaatatcacgattttatcgtctgtcaagtattagtattcatatgtgataaataataatatacaccatggtatagcatcaggtcaattgtcacttatcccaaaagatcattattgttttcatcctgtcttataatatatacataaattcacaaattttataataattgggagggttttaatgccacgatcttcgcgaacgatccggactgacacagagtgacctcgcgatccagctgggtatgacaaggtccggtgtcaatgcctgggaaatgggcatatcgaaaccttctcttgaaaatcttgtaattctaagcagaatcctgcatacaaccacagattatttacttggaaataataatgaagaaacaattgtgattaatgattttactcccgaagagaaagaaatgttcatgcgcatggtgcattatatagaagaagtgcaccagctgaagtgtaaaaaaacagccctcccgtcaaataggggggctgtttcgttcctcgatcaggaatcttttttcgccttatcaatcatataaagaatatctgcaagctcatcttccggaattttgacataatccgcaagctctttctgcgttggctgtgcaccgttctgttttttcagatagttcaccgcttcacttaccagcgcaacttttccaaccacggaattttcattctcatcctcaccggtctgctcccggatgcaggatttcatcgcttcttccaccgcggtaagaagttcctcttccacatccactttttcgtggctgccgcacagctcgctcaggcgcaggaaaagtgccatatttccttcctgcacaatatcctcaaatccttccggggaaactgccagtttctttgctacttccagtacgttgcgcagccatgcattggagagcgcgtgtaccatgctctcttcccctgccagcagcttcttatacatatcaatctgctgctccttggtatactccggaatatctttcagttcctccagatacatctgaaacataggagaagtggaaatgttgtctgtgacggaatcttttgcggattcctttttcgcagaagattctttggtttcttctttctctgcggtctcctcatattccgcttcctttgtttccggttcgttctcttccggctgcggatcatcatgtggtgttgacagaaactctaacaccatctcttcctgctgtgcattcaaatccatatccttaaaataggaaaggatctcctctcttgtcatcggctccgccgaagtgcggataatatcctgtaccgcacgtatggtttctgtaaatgtattctggtctaacatatcaggtctcctgttcctcatcataacattcgcttctgatccgcgaactgatctcctgcagacattctatgaggatcggattaaactgtccgcattccccatgcaggatcatttccagtaccttttcatgcggtactgctttcttataaacacgctcactcgccagcgcatcgtacacatccgctacagaaactacctgtgcggaaatcgggatttcatctcccacaagtccatccggatagccttttccatcgtagcgctcatgatgccagcggcagatctggtgtgcgatctttaccagtggctcgtcctgataaataccaagctgttccagcatttctgcaccgatgacggtatgcgttttcataatctcgaattcttcttttgtcagttttcccggtttattcaggattttttcatccacaccgatttttccaatatcatgcaaggacgaagcaagtgcgatcatggctctggtatccccatccagatgatacttttcggttttctgcgccagtctctccagaagcatctccgtaagtttgtgaatgtgaagcacatggcttccgctctctccgtttctaaactccacaatatgactgagaatatgaatcagcatctcgctgtttttctctttttcgttgatctgcgcggtaatcagggaagtcagccgacgctgcttcgcatataatttcatggtgttcgtcacacgctgataaacgatctgtgcatcgcatggcttgctgacaaaatccactgcaccaagtgcatatgcccgcttcacagcctccggggcatcggctccggacatcataataaccggaatatcctcaatccagtgatttttattcatatatgtcaggacatcaaatccatccatcttcggcaataccacatccagcagaaccaaagaaatactattgacctgccgttccagtatttctatgcatttttctccgctctccgcctgcaggacatgataatccttggaaaaaatcatatccagaagcgtccggttgacctcctcatcatccactacaaggatctccggaatcatcttttccggttgcttctgtgcgtgtatctttccctcatgatcaatcatgttattctcggtgatggccatgtttttcttattttttgcctgatacatcagtttatgtgcgcgaagcattgcatgctcaacagattcgttctgcgaaatcacggcacccatactgacagaaagctgaatattggaataccccggaatcactgcattctggatcttttcctgaatctcctgcagtttttctaccagaccagcttcctttatctccggcagcacaagaacaaattcatctccaccatagcgcacaagcgtatcctctctgcggatacaacgccagatcacgccagcaaccgccgcaagtgccatatctccggtcagatgtccgtatgtatcattgcaaagcttgaaatcatccacatcaatcacaacaattccggcatttcccgtccacatttttatctcttcctcaaaatacagacgattataaactccggtcaggacatccttatataatttttcattatatccggtcagtttattgatcagcttttctctgcaggatatgtcgattaaggtgtcgtcctccagatgattgatcaattccatgacgtatggctgtccatcaatttccatataccgggagattacctgatagacttctgattccagaaattccagcttaatcatctgcttcttttcccgcaacgctttataggaactgcagttttcgcacttaccgtttttcttccagaaactgtagcacggacatccatcctgcacattttcgcacgttcctttcccttgctggtaaaatgtccgctcaacatcttctccttttaacagacgtactacctgaaaaatcttctgataatatttgatttcctgttctgcttcctgcatggtcatcccgttaccggattgcatcacatctcatcctcctggtctcaaaaattcaagtcaattttaatccccttcagatcctcgtttacgagattgttctttttaagaatcgtctggatgtgctgctgcgcctcctccagcttactcgtacccgtctgatccaccgttacatctgcctccagcctgtctgcctcgacagaaccctcaatcatcttctcctgctgctgtttttcctctttcttttcgtcaatcttttcctgctgctcgtcgcgcttctcctgcgcttcctctgctttctctttctcttcttcctgtttctcgtcgatgtgatctaccgcatcctgtatcagcatgccaaaagcatctttatcggaagcatccagcagttcatccgctgcatcctgcgctttttgcatatcctgtgatttcagctggtcgagctttgcatctgccgctgcctcagtcagagaagtcacgttacgctgcgccctgtctttcttgttcagaatgacatccttttgtgcattcagctgtaatgccctggtctgataatcggtcagagaggtattctgcagttctttcaaacggtctatctcctccttggaaaagtcatccgtctgcacacctttctgataatcctgatatttttccagcagttctaagtctttctgctcctgggaatccgaatccaccccataactctgccgcgcgatttctttactctcgcgaatctgtttcaattcctcgttacactcacggacttctttgagtttttcctctttctgctgtgctatctgatcccgctggcttaccgccttgttatcactgtcccatgcatcccggatcagcttcatcgcctgtttccgggcgctctgtttcttgtcgcttgcagcattgcctgtggtctgggcgaactgcagatctccggcatatatggttcctttgtcggatactttatttttgcgcgtttcatcgtctccgatttcgtatgcattcatgttagcatgtggtgcctgaatcgtcaatgacatatgataattccccctttatttttcataatatcattttatatatcgaacattttctggaatttctccatatatccggcaaaatattgttaataggaactgctgtctttatactgctgctcatccaccagattctgttttaatgtcttaaatgcctcatcccaggtctgccctgattcattttttctgttaaattcgttttctttatccctgacatagttttgtatcggcagatcgatccggtaaaccttttgttcaaacgcccagtaatcgtcctccgaagcaaaacccgagagcagtttttctttttgctcctttgtccagataccatccagattctgttttaattcctctacatatgcttttacctgttcatcggttacctgatatccattctgcattgccgcaacatacagtgcgttgcgttccttggcataagcaattgctttcttttccgacaatgtcttatcatatgtaatttcataaaacttcgtatacatctgtacctgttcccgggttacaatcgtatgatttccaatggcacagatttcctctttgtcgatactctttgtcacacgctctttgtcggaagacgcaaaataatataccgaagcatccgacttctgcagtgttttcagataatcgccaatctcttcacagacatcttccaccacctgttcaaatgcatccagatccgtctgctttgcaccgctttcatatgcctcctgtttgatttcttcctccgtctgcgttcctgtctggctgtctatatacttgcgcaccgcaagattctgacgaataaccggctccatattcttccagtaagcactctcgccaccgaatcccgcataaaaatcgcggatttctttccggttctccgctttgttcatctgtgtcttcagcagttttgcataatcatcatattcctgatccgacacagtacatccgttcttttttgcaagtacatacaacgtcttttttgtaataatatcttttataacctctttttttgcggtttttaccgtttctccgttttccacacgcaatgccactcctgcctggatttcctgctgtgttaccggaattccctggatacggtaaaccacctttgcagccttccccgtaaatctggaaacaattgttccaagccggaaaaaggaagttcctccccctacggacacaccgactcccgccaaaacaagcatggcaagaactgctgcagctgctctccatttaaaagaagcctttctttggtgcatgtcatgttttggcttatatgtatacgcttcctctataatgtcatcactaatttcaccgattgcatcggataatttttcggattttctcataacactacaccctccttctccagttcctttctcagctttttgcgcagacgcatcagttttacggacacactgttttctttcatcccaaacgtttccgcaatctgtgcgacagactccgcataccagtaccgtttgacgaacatcacgcggttgccggtatccagttcccgtaaaaagcgttccaggactttcgtcacctcctgttcttcccacggctcctgctcctgcgctgccggaatacattcttccagttccgcaagcgatacatcgtaatagctgttgcgctttgccgccatgttatgccgcagccttttgacggacagattgcgggtaatcctgcagacataggagaccagcggattcggggtctgcggtgggatgctgttccacacaccaagccacgtatcattaacacattcttttgcatcctcttcgttatttaagatccggcgggacaggctctgacagagttttccgtatttctgcgacaattcggcaattgcctgctgtgaccgctcctgaaataagcggatgattgcagtatcttccatgatgattcctcccttctgttggatgccagcccttttaaagccacctgcggctgggactggagcatctcttatctgtatactaccggtttctggcgggatgtgacgggcagatgtgtttttgtaaaaaaatagcatctaacatttctgttaaatgctatttggacaccaatttaaattatatattacactgacttcttttttacaatctgtaattcatacccgagagcatctaagatacgactaaatgcccgaattgtcgggatactttctttcctttcaatccttgatataacctgttgtttattccctgtcagcaaagctaattccctttgtgtaatttttttctttttgcgtaaagaaatcatttcaccaatcaatctatactctgcacgggactcatcccatatttttttaaactccggatcgttctctctttgcttttgaatttcctgctctacatttacttgcaaaaaaggcatattgaccactccctctaaataaacttcctgcctaacatatttcctaattcttttgcccgcttccgtactatatttgcatcctttttttctgttttatttttctgttttcgacaggaatggagcagatatatattttccttatctactgtaatatagaatacacggttatttttctgaaaatatacctcatacactttcttttcccatcttttaaaaagaattttatcaaattctcctttttccatatgctgcagtacggtataaccatcaattttttcagcttccggaagactattaatgtattcatatattaaatctcttcccgaattcgaaagataattgtgtaatatcatatgctgtctccacttttgttttgtaattacaaaatacagcatatatgttgtattgtcaagagttattctctgtcttatatatctttttcacttaatctactacggttcatcatttctccttcgaacagttattcctaatcaagtccttccccaagaagtcccagccccttgcggtccgcaagactctgtgcgccttctttgacttcctccttcgaataatcgtgctcttcaagaaattcctccggaagttcattcagataatcgtaaaatccgagtgctacttcaaatgtgccctcttcatctctttctaattcttcatacaagcgattttccgcttcattgatttttcctgcatcgaccagtgcaatcagccgggcatataaactgtccgttgctgtatgacgatcctcttccttatattcataggtcgcggtgtttttcccaaataaaatttttgcaagcatgcgggtcatgtcacgtacctgccgcataataatatcattctcgtatgccatgattgttgatttcctttcttttttgctgttgtgtttccagttattgtgcctttttagtaactgtatattttttcagaaaacagcaccttttctatcgctatatcttttgggctattataagtttcctgtaattataaaattcacgatgtttgtgctggcaaatggcaaatatgttttttactggttgattatgtcctgcttttactggctggtgggacatatagccttttgctagttccctatgtcccacatagtctgatcggtgggacatatagctttttactgacttcctatgtcccacatagtctggtcgataggacatatagcttttttctagcccactatgtcccatccacactgcctcatgggacttttcgcgccacttttcttgcatatgtccctctcgcactgtctcatgggactttttgcaacactttttctgcatatgtcctgctcttgctacctcgagggacttttcgcgccacttttcctatatatgtcccacacccctcatattcttgaaaacccggctttgataaccacacttattcactctttctcatcttattatacacactctctatatattatcaatcatcctacatactttgatctatatatttatactgttgtcccaatcatatagaaaaaacacttttaatctttacaaaaaaaatatgaacccccctatttatgtgaagcccagcaaaagagatttttttgcaaaaaccgatacagttcctcatcgctccgtatatttacccgttctgcccgcagatactccggcagactgttttcctccggatacatcccacagatatccactccgatcacatcatattccgtaaccagcgtttttaatatctgttccagcattcccattgacatttttccctggtcccagtttgtcactgcatatttttcgtccagcacatccttgtcgatggaaatataaacagggacttcatccggcagttcttttattttttcatgtgcttttccgttttttaattcctcgtaactgatttcaacaagctttccatctgtctcctgctgcctggctccagactgtaacttatcaagcgctttcttctcctgcccgatcaaaaccagcctttgcagatacgggttttcctgcaatacctttttcgcccagtttccgcaacttaagatatctccgcccagacttgcatcctgcatatccgtgtgatggtcaattaacaccagcgtaaacggctccttgataaaatccgtcataattttggaaatataatgataatcccccgaatctataaaatgaattccggatactccggccggcgcaatcagcgcttttattttttcttccgcatctctgctgcaatacagacggctgcctccgatcgcactgcagtcatgccactttagtcccggttcttttcgctttggataacattgtgtaaaatcaaagatcatgtttcggtttttcaaactttcatcctccctttttcacaggcgattgcaaaacacgtgtggcacatgcgcattctttgcaatcgcctgcgatatattataagaaaaaggggacagcctctcgactgtcccccttctgaataattagccttcaatagaaatatacttcttttcttctaccttcggtgcttcctctttctttggaacttccagtgtcagaacaccgttttcaaattttgctttcacgtcatcctgcgttactgcatcgccgacataaaagcttcggctgcagcttccgctgtaacgttccttgcggatgtacttgccatccttatccttctcatcgttattcttactggtggttgcggttacggttaaataaccatcctttacctcacctttgatatcttccttctggtatcccggaagattcattgttactttgtatcctttatctgtctcagacacatccgtctgcattgttccgtttgatttgtatgggaaaccaccaaagaaatcattcataaaatcgttaccaaaaatactaggcattaacataagtcatctctccttccaaatcttaatcatctattttattatcaaagtttcaagagattattcatttctctcaacctcttttccctttgttcatgatatgttataccaccgtttttagcactcgtcaagtaggactgctaacaatttttgtgaagattttgtgaattttctaaattattctgaaaattatattattttagcagaaagagccatcgttttcaaagctcattttcatgtaaaatatgctgcatttatgttacattatataaatatatgaaaaaaataaaaaatgctgtaacgaaacaccgtatttttacatcaataaatgtaacccatataaattccagaaaaaaggaggtcgcacatgcaggatatggacgcagtctaccgtcagcattttcgcatggtgtatcagtacctgatgtcactgacgcaccagccggatgttgcggaagaactggcacaggaaactttctgccaggctgtcagcagtatccaccgctatgacggaagctgcaagatcactacatggctttgtgccattgccaaaaatcaatatctgtcctatctgcgaaagcacccactgcacgaggatctgacagacaccgaagcggaacttccgcacacaccgtctgcagagcaggaggcgctttcctccgccggaaaaatggaattgctgcaatgcctgcaccagtttcaggaaccctaccgggaagtgatctatctgcgggtatttggaaatctctcgttccgggaaatcggacaaattatgggacagagtgaaaactgggcgcgcgtgatgttttatcgcggcaaggagcgcctgcgaaaggagctgaacaaacatgaaaaatgatttgacctgtgaggtcgtacaggatctgctgccaagctatgtcgatcacctgacgagtgacgtcacaaatacggcgatcgaaacacatatccgggagtgtgccgactgtcgccggatactttccgatatgcagactccggaacccgtgccggcagaaacggcaacggatgcttcaactatcgactttctaaaaaagaacaacaaaaggaacaaacgccggattcttgccgccatcctgatcgtgacactgttgctcggcagcatctggggatatcggacgtatttctaccctgcaccgctgaaaaataccgcactgatcgactatgcggttaccgtaaaagacaataaaaccattcagattaaaggatctttaaccgatcagacacttggtgttgccggaatcgactactcctgtgatccggatcacccggaaaccgtcacaatcaatgtcagaaccaaccgcatatcggcagccgggcacaatacattttccgataaaaagacagaaacccatgccgtaaaaaaagtatatgtgaacgatcagattgcatgggaggacggcacctctattctgccgaaagcagcacagatttatgccacgatccatccatacatcggtgatatgtctgccaatgaaaaaacacttgcggcacttggcatctccaatgtattttcgattgcaaacttcaaactgcagaccacggaaaccccttacggctggaccatatatctggatgacgcatttacaaaaaaacaacagaccacagttgaaaaaaccatgaaaaactatgccatggtcattctcgcctgcaccaaaaatctgggaagtgtaacgttttcctacacattggatggaaaaacgacagattttacttatacgaaagaacagggagaaaatgaatttcttggcacctgtaactacttccgcagttctgccacagagtttcagacactgcttgcaaaaaccggcatcttaagcgatcccgtcttttccagactgtccggaaaccagggataccgcctgacggagcagctcaacaatgttccggatacagaaattaccgggacgattcaaaacgaaaaacaaaatattattaagcaatatgaaagttatctgccgaccaacagctggtcgccgggatcaatcagcaaatcattttcttccgaaaaagatgcactcgcttatatcggatacaaaaatctgcggtcatttgccctcccacagaaagcagacagcatttccgtcaacgcaaccgcggataaaaaaggaaacatctgctacatctcgctttccgaactatacagttgtgcagacggacagatcaatgtgacggccgccgccgatctctatacagaatcatccaacatcggttcctatatcgatatggactatccatcgtatgaggaaacgccggatgccgtatccaccaacgaactgtacaccacggcttccggcgatacctggcaactgattacgaccacctctcagggtgatgatttcaatgattccatagacgcttaccggaccgaagacacgattttatatggcattcacatcggttacccgtcgaacctgaaagaaagcgcacaggcagaactgaaaaaaattttagaaaacggcatcggccagaactaagggatttataaaaaattaagaaacctttttcaaaaaggtattgagccagaagaaaatgttcattataatccattataaaacaataaggtgaataccccggccgtatctgggagaaaggaaacatcccatccagtctgactggatgggatgaacattgataaacatgaaatggatgatagcatctgatatccacggctctgcatactactgcagacagctgttaaatgcatacaaccgggaacaggccgaccgtctgctgctccttggcgatcttttataccacggtccgcgcaatgacctgccggaagaatatgatccaaaacaggtgattgaactgctcaacgccaaaaaacaacatattctctgtgtccggggcaactgcgatgccgaagtcgaccagatggtactccaatttcccattatggcagattactgcgccattgcagacggtgatacgctgatttatgccacccacggccacacgtataatgaacagaacctgccttcactgcatcgcggggacattctgctgcacggacataaccacgtcccggcatgcgtcccacacgacacatatacctgcatgaatcccggatctgttgctattccaaaagccggaagctggcacggctacatgattatggaaaatggccgtttccagtggaaaacaatgactaacgaagttaaaatggagtttgcagacggaaaacgcattctctaaacaaactcttttacggaagcatagatgccttctgcattcagaccatacttctcaagcagtgccactgccggaccggactcgccgaagcagtcctgtacaccgatggtctttaccggtgtcggtgcctttctcgaaagtgtctcacatacagcggaaccgagacctccgatgacagagtgttcctcaacggtcacgactttcccgcattcttttgctgcggcaacgacaagatcctcatcgagcggcttaatcgtatggatgttgatcacttttgcatcaatgccgtctgctgcaagtttttctgcggctgcgagcgactcggacacacacaaaccagtcgcaatgattgccacatctttgccttcccgcaaggtcacacctttgccgatttcaaatttgtaatccggacggtcattgatgatcggaactgccagacggccaaaacgcatgtaaaccgggccttcgtgttcatatgcggcttttactgcagcttttgcttcgatatcatcactcggatttaagatgaccatgcccgggatggtgcgcatgagcgcaatatcctcattacactggtgcgttgcaccgtcttcaccgacggaaattccggcatgggttgcaccgatttttacattcaggtgcggataaccgaccgagtttcgcacctgctcgaatgcacgtcctgctgcaaacatggcaaacgaacttgcaaacggaactttaccggttgcggcaaggcctgctgcaatgccgatcatgttacattctgcgataccacagtcaatgtggcgctccggaaattcctttttgaagattgcagtctgtgttgccgctgcaagatctgcgtctaaaacatatacatcatcatgctcctttgccagctctacgagagcgtttccgtagctgacacgggttgcgatttttgttacttctgacataatgcttcaccttctttcttcaggtcttccattgcgatcgcatattcttcatcgtttggcgctttcccgtgccatcctacctgattttccatgaaagagacaccctttcctttgaccgtatgcgcaatgattgcggtcggctgtcccttggtgtttcttgcctctgcaaatgcagcggcgatctgatccatgtcattgccgtctgcaaggtcaaccacatggaaattgaatgctttgaatttctcgttgatcgggtacggagagcatacctgatccaccggtccgtcgatctgcagtccgttgttatccacgatcacaacgaggttatccagtttgcggaatccggcaaacatggcagcttcccatacctgtccttcctgaatctctccatctccgagtagtgtatacacgcggtaatcatccccggaaagtttggcggacaatgccatgccgactgctgcggaaattccctgtcctaaggaaccgctcgacatatccacacccggaatgtgcttcatgtccggatgtccctgcagatacgaaccgaggtgacgcagtgtctttaaatcctcgaccgggaaatagccgcgcagtgccagtgcggaatacagtcccggtgcagtatggcctttggacagtacaaaacggtctctgtccggtttcttcggatcttttggatcgatatttaattcttcaaaatataaataagtaaaaatatctgctgcggaaagcgatccgcccggatgtccggctttggctgcatggacggcagtcacaatgcctttgcggacttcatttgccttcagctgaagttcctgtttgttcatgttcgttcctccgtatgcgtgaacatcagcccatgaaaattgcctgcggcaatgggctgacgctacatttcagattttcttcgaaaatctgaaatattactccccaaaaactgccttatagtctgcctggaatttttcgattccctgatcggtaagcggatgctttgtcatctgctcgattaccttgtaaggaatagttgcaatgtcagcgcctgcaagtgcgcagtctgttacatggatcgggttacggatggatgctgcaatgatctcggtgtcatatccgtaaatatcaaagatctctgcgatctgacggatcagctcgatacccggctggctgatgtcatctaatctgccaaggaatggggatacataagtagctcctgcgtttgctgcaaggattgcctgatttgcgctgaaaatcagggtaacgtttgtcttgatgccctcggaagaaagtacctttacggctttaagtccctctacggtcataggaatctttacaaccatgtttggatggatggctgcaatctcacgtccctctttgatcatgccctctgcatctaccgttgttgcctttacctcaccgctgatcggtccgtcaacgatggatgtaatttctttgatgacttctgtaaaatctcttccctcttttgcgatcagggatgggtttgtggtaactccacagataacccccatatcatttgctttcttaatatcctctacatttgctgtatccacgaaaaacttcataataaaatacctccatttttatttacgtttgtttttatctgtcagccttaatatagcacagttcaaaagcaaacgcaagtataaaacaaaagagaataaaagttagtgcaaataaataaaagacacagatacagttctctgtcttttgacagaaaacgtgtctgtgcctttttttcatcaaaataactttctttattattgatacattttatattccaagcactcctgcagcactgcgcagttccgcggctgcccgctgcagctcagccgcctgctcttcggacacatttcccggctttgtacggctgaccagtttctttacataagaaaggctgctcttgatctggtgacgcgcaccactgtcgatggtctttttcttctctttataagctacttccacctgacggatcaacgtgtcggcctcgcttcgcgcatcaatataagcctttctctgcccgtctgttgcttcatattccgcggcttctcttatcgcgcggtcaatctctgcgtctgacaaattggaacttgccgtgattgtgatctcctgatgccgtccggttcccagatcctttgcggaaacctgtacaataccgttcgcatcaatatcaaacgttacctctatctgcggcacacccgccggcgccggtttaatgccccgcagctggaaccgcccaagcagcttgttgtctcttgcaaactgacgctcgccctgcagtactttgatatccacagatgtctggaaatttccggcagttgtaaacactttactgaaccgtgtcggaatcgtggtattccggtcaatcagcttcgtcgaaacacctcctaccgtctcaatggaaagcgaaagtggtgtgacatccatcaggataatctctgccgcctgtgatcctgccatcagcgcaccgccaagttttccaccctgcacagccgctcccagtgccacacattcatccgggtttaaattgcgtgaaggttcttttcctgtcagtctgcgcacttcctcgaataccgccggtacacgggtagaaccacctaccagaagtaccatgccaagatccgctgccgtaattcccgcatccgaaagtgcctgctgcaccggacctgccgtgcgctcaatgagatccatcgtcagttcctcaaattttgcacgcgtcagagtcatttccatatgctttggctcaccctttacggtcgcaataaacggcaggttgatgcccgttgtggaagaggaggacaatacctttttggccttttccgcctcctcacgcacacgctgcatagccgtcgcatctttccgcaaatctacacgctccgtgcgctggaattccgataccagatactccgtgatacgcgcatcgaaatcatccccaccgaggtgattgtctcccgcggtggcaagtacttcgatgaggttgtccccgatttcaataaccgatacgtcaaatgtgccgccaccaagatcatacaccagaattttctgtggctccccgtgatccagtccgtatgccaatgccgcagatgtcggctcgttgataatccgaagaacatttaatccggcaatctttccggcatcctttgtcgcctgtcgctgggaatcactgaaatatgccggtacggtaatcaccgcatccgaaactgtttcccccagatattcctccgcatcttttttgagtttgcgcagaatcatcgcggaaatctcctgcggcgtatactgtttgccatctatttttgcccggaacgcacttcccatctcacgcttaatggagaaaaatgtccggtctacattgacagctgcctgtcgtctggcagcatctcccaccaggcgctctccgtttttggtaaatgccacaaccgatggtgtggtccgcgagccttccgcgtttgtgatcacaaccggctgatcattttccaaaacagcgacacagctgtttgtcgttcccaaatcaattcctattaccttacccacggtcttttcctccctgtctatgtgtatccacacatctcttaattacaagagtaagtcgggaaagcccctgcgtcaaggtttccggcagatatttcacttattgtttatacttttcataattccttctgaattaccacatctccgtgatacatcaggaagcgaagccccacggtctttttgagatctccatgtccatggtgcttcatgtttcctgccacaactgcaatattggcatctccctctgtatttgtacggtcaaatgtaaatagcgtggaattatggtattccaccacctccgtatccactcccagataatccgacaattccgcacgcgccccgatccgcaggatatgtcctcctgcaattgcgacacccccgtcaatttcttttttgctctgtgggattaccacaccgtcgcagagtatgatcatttctgcatccatagattcgcctccttttcgactcttttttcgttatataaaagaagagcttcctcttatccgagaaagctcctttgctaatcacctgttctgtttacgcctactgtagcagaaaacgattggaaacgcaagtacactcccgtacctttttcatactacaaaaataccaactgccaatattcttcctgtatactgtctgttcccggcaatctttggtgcaaacctgagtgcatactttttatcttttatttgtgcaatagcctcatccggtgtatgatctatctttaattccagaatcatacaatcagcagttttatcacttctgtgttatgggcaaataacgtcaaaaatgtatttaccacaaacagcgaaccctcataaattccttaaaatcaggcattcgctgtttatgtccaacaatttcacacgtggtttagtaaatgaaacttacctggtcagttaaaactgcgtacttgataatgttttcttactgtttattgtgtcaggcaccacatgtttcaatatttctacaacttttcgatgtccgtaaccagcatatcaacctcgtcctccgttgttgcccagctcgtacagaaacgctgcgtatcaccttcgtcttcaaaataatatttttgcgcaagctcctgcttctgctgctccgtcagaataacaaactgctggttggtaaagctctccaccgcaaacggaacacccttgtcctcaaacgctttcttaatctgcattgcaagcgcatcggcgcgcttcgcagcctcaaaatactcgccgctctccagcatcgttgcaaactgcagtcccatcagccagcctttcgcaagtactgcaccgttctgcttcatgtaggccttaaagcgatacttcagatcctgcgcagtaataatgagcgcctcgccgaacaaagcgccacactttgttccgccaatataaaatacatccgtcaattccgcaaaatccttcaaagtaagatcatttttctccgatccaagtccatatcccatgcgcgcgccatccacgaaaagatacatcccatattttgtgcacacatcatggatctccttaatttccttcttcgaataaagtgtacctttttctgtcgggaaagacagatataccatcttcggttcggtcagatactccggctcgtcctgatcgtaatacgccttggcgcaagcggcgatctgctgcgcggtaatcttgccatctgtattcggaagttccagaatcttgtgtccggtgttctcgatggacgccgcctcgtgacaattgatatgtccggtatctgcagcgatcacgctttgcaccgaagataatgcagcagcgatcacgacgtaattcgcctgcgtggctcccggaatgaatttgatcaatgcatcgtcatcatcgaccagcttctttatgatggtttctgctttatcgcaccactcatcttccccgtatccggcgtagcttgtgctgttcgttgcgccaagttccttcaatatggatgcaaatgctccatggttgtaatcgttattaaatcttatcatttcttacatactcctgttcaattagaaaaggcatcaaataaaatggtttcagtaacaagttttcttcctttccaacatccttctgcgacaataaatatatatcatgcacatttttcgaaaactttttatcgaatacctttatcgactcatgttttccagatccagatgatttaatttcgaaagcgttcactttgcttccttccgagatcaggaaatccacttcataataatgcgtactgcctgacttttcccatgtgtgatagaaaagctctctgccagatgccgcgatcatttgtgcaaccagattttcatataagaatccgaaattagccggtaatttgtcagaaagcagctttgcgtacacatcattttctgtcaccggtcgatccataaacatcaatgtaacaaacaatcctgtatccgcgaggtagagtttgtaactgtcaaaatcctttgtgtctgctaaactcacacgtggatcggttgaattataacacggcaaaattgtttttgaatcaatcagctcatataataattcctctgtttttgctttactcttcttcccgattgctgttgaaatccgatatttttttgaatctttggcgagctgcgccggaatcgaatgatacaatgcagaaattcttccagacgcatcaattttcttaaaatcatcttcatacaatgatatgatctgtctcttgaccatatcaatttccgagaaattcttaccttccgtgtatgcttctaccgcctgcggcattcccccaacagccatataaatacgcagatctcgcattaattttcgattcgttgcctgtccgattgcagatcctgtaccataaatctggcgcaagagctcataattagctcctgtggcatcacaaaattcttcatagtccatcggatatacctgtatcttcatctcctccgacggaatcaaaatgtcttttacatttttcttaatcgagattagagatcccgtttccagataactatatctgccatctgccaccagatgcttgatagcctgccttgcctgtgaaaaaagctgtacttcatcaaatatgatcaatgattcatgttcgtataaagtcactcctgtttcggcctgaagacgcaaaaagaacatatttaaatttcccacatcctcaaaacaactgcgtatattgtccgttgtctttgagaaatcaatcaaaagataagacttgtattcattttgcccaaaagactccgcgatcgttgatttaccgactcgtttggccccctctagcaaagccgcatatttgtctgagtattttgctttccattctaacaatctgtcatatgctttccgtttaaaatacatcattacctcccaaatatatccttgttataacatgaaccgggcatttcttcaagattatattttgcgtttttgtccgtttcttcaagattttcatcaaaaaaagcgcccttgtctgatatgatacctctaaagtagacagattaaatatttattgtgtcagacacctctgatttctgatttcaggtgcttattacctgaaaatgaatattttttaaaaagtgggaatagaataatgacagaagatacagattgtgttaatatttgtttgaaaattatattaccgaaaaatagaaaaaattcgaaaagtgggaataggggatggcaccatgcagcttatagtaagaaaaaagtatttagatgaactgattgaattgtatggaacaccagatataaaagttatcacagggatcagacgaagcggcaaatccgtattgctgcaagagtttgttacatacttgcaatcaatagtatttacgccaaaggaatctatgatatttacattaccggttcaaatgcatttttgctgagttcagatttggcaacactttttaccggaagaacgatggaaataaaggtatatccattttcttccatggaatatctaacttattatgaaattacagatggatatgacgatgcatttgatcagtatgtccgaactggtggcatgccgggggcttatgtatataagactgaggatagacagtatgactatgttagagatgtgtattcaaccattcttgtcagagacttggtagaaaagtataagataagaaataaatcagagtttaccaatatatcagaatttatgatggataatattggtaacttactttctccaaataatatcagcaaaaccttaaacaatgaccgaagtgagataacccgaaagacggtatcgaaatatattggttatttggaaaatgcttttctgttctatgaggcaaaacggtatgatttaaaggggaaaaaatacctagcgaacaatagcaagtattatctttgcgattcatcattccgttatgcagtcaatggtacacgtaacatggattttggaagagtttatgagaatattgtttatctggagttacgcagaagaggatatgaggtatatgttgggaaactctataaaagagaagtggactttgtagctaagaaacgtgagacgcaaatatatattcaggtaagcgataatatttcggatgaaaaaacatttgaaagagaacattcaccactgcttgcaataagggatgcatatcctaagatgataattgcaagaacgcatcatgaaacctatgattatcaaggtgtgcaagttgttgatatttgcagatggttacgggaataatatcattttgaaaatctctactgtgtgacagaacttgttgaaacgtcagatcctggaattcagcctttttcaactatccagaccaaaagcggaagtaaaacacaacgttatgtaaattcttctggtgctactttatggtatgtgactatacatgctttttttacctataatggaagcacttcttcctgcacaagcactgatgttaccgcaggaagtaattcttcggcatggaaggttaccaataaatcgagttggaaatccgggaataccggatatgcttctgcaacaggctcccatatcctttccaattccgaaatcacttcaactacgcgtactgtttccatttcctgtaccaaaaacggaactttacagtaaaaagaaaaccgtgatgcatcctgatatgcaccacggtttttcatacctgcaaatattataaatatccggcatatatcccccggctctgatttcatatccctgagacaatggaatcatggctccatgcatattctaccgatagatataccttttcccctttatattcataaaatttttgttcttttccatccagaaacaatctgtcatagtctgtatcagctgcaccgcttgaacctctgataattcccatatcactgattccctcaattgcacgggccgtaaaagcatgcgcatacactttcttatttgacgcatcaaaaattctgcagtcattataatctggactattttttatataaatagctaattcatattctccatcattatcccagtctgccaccagaaattctgcccactggggccgataaccttcttttgtcaatgcttttataaaagaatccttatcatattcttttcctttttccacatcaaagaatgtttgattatctgaaaaaattttctgtatcttctgtggaagtttttccagatccttttgtgtagaatgaacctgtttccaatcctcttcctgtgtttccgtagataagacagctgtttctgtattacttttctgttcttgatctgcaggagctttgcaacccgcaaataataaacagaccgttataataattaccggtaatattttctttaacattatttatcccttcaaatactctaactatccattgttattaaatatgcaattttattttctgcatcatatacacaaaaggaaacattcgtgtacatttttgttcctggattccgatcaacaagtttccaataaccatcttcaattgttggaagttcaatataagtagacacacttgtcaaaaaatccccagcctttttcgaaaacggcaaactctcccacttcgcaaattcttcagcagcatcctcatccagagttatcttataaagagccattccctcatatggaaaacctccataatcattaaactcttctttaagttcaatatccttttcctcaatatctatatcaaaatctttaataaattgcgattttgtatcatctttttgagtacacccaacaaatcctatcaggctaaaaattattataaaaatcagaaaaaactttttcatatctgtttcctatacaatatagcttatgttaccttatatcctaccacagctattatctttcgccctttcttaataaatgcaatctttttcccttcattctgtaaatcttcaaccgctatttttatatttttctctaactcatggatttgtttatatttttcgacgtaataaccattcgttgctgcatttacattgttaatttcattaacaaatatagtttccaactgttccaagtcaattttctgctttggtacataagaaaaaatatctaatacactatattcttccattcatcctccaagatatcatcattgcttgttatgttttcacgttagcatattcaattatctatgtcaactacattttagtttttctatacattgttttattatcttgtttgttttataatacgtttatctaattagataaggagaaacctatgaacaacaaaagtaacttccggcgcggttccgtcgaattgttaattttgcatctgcttagccagcaggactattatggttatgaaatatcaaccctgatccgggaacagaccgatggatacctgaatattccagttggttctttgtatcccgctctctacaaattaatagatgccggatatatttcagactacaaaaaacaggtgggacgccgtcaggtgaatgtttattatcatctggaagacagtggccgcacgcatctgcaacaacttttggaggattattacgcgactgccaatgcgatccaacaggtattgaaatatacggttacacagtagaaaaaagggggatacaatgaccaaggataaaattacggatgaatatataaaggctgtgcagaaacagtttaagcactaccatgccgcagacacaagatttatttctgatttgaaagacgctgtcatttcttatgcagcgcaacaggattctctcgattatgaacagcttgtctcacagtttggagatccacaggaactggtaaacgattatttttcggagcaatcaattgataagcaaaaaagaagcctgcgcttttcacgaaatgtcaaaataacctgtaccattgtaattttgattgtcttggggtgtattggcattttcttttatactctcaatcatttagcccaagaagagagaaatgcttttattcaccgagaaatcattattttaaaggaggatgatacccaatgaaaaaatcaggcaaatttatcaccgctttattactttcttccgcacttatatgtgccgcaatacccagtcagtctcttcaggcacaaaccgtcacgattacaaaagaggctatttccgatgatctctactgtgtgacagaacttgttgaaacgtcaggttctggaattcagcctttttcagctacccaggccaaaagcggaagcaaaaccgtgcgttatgaaaacgcttccggcactactttatggtatgtgacggtacatgcttcttttacctataacggaagcacttcttcctgcacaagcactgatgttaccgcagaaagtaattcttcggcatggaaagttaccaataaatcgagttggaaatccgggaataccggatatgcttctgcaatcggacatcaatataacattttaggcatggaaacaaacacactttctcgtactgtttccatttcctgtaccaaaaacggaactttacagtaaaaagaaaaccgtgatgcatcctgatatgtaccacggtttctctacataattatctaaaatttttaatcacacaggaatgtttctttgtcttggtgctataattgattccaaccagaagaacctccccatcatatcccaattttttcaccaactgcgtataattcttttctttgatctgtgtaatcgctttttctgcagatttgtcccatttcaactcgatcagtaatgcaggtttattgttgccttcaacaaatgatctgacagctgaattgctttcaccagttcctgacgtctgccgtttttgattgcacgaataaactcttccctgatttcttcgtttggaatatacacctctttattgtctgcatcatatcccagatatcccagatgcaccagtaaagtaagtacatcatcccggcttttcatggaagtcatgtcattctgaaaagacccgatatcgacccggcaacgctttcctccaagcatatcgaccagacattccttcagaccatcaaaatttaaatctatataaattcgcagtgattcataagtttctgtctgtgtccagtaattactgtattttccgcaaaaaactgcctttatcaccgaatttggattatacacatgcccgatctcatcaaaataatacccatcgtaccatctgcgcatttcctcataatccatgtgatgaccggtacacagcttttttacctcatcctctgtaaaaccaacatagggtgccagcggtcccggctcaagcatcgtaaattcggtaaaatcggtaagggccgactgcgttccatattttttgatcggtaaaattcccgtcatataagctccacacaaaaaacgggaaacctgaattcccttgaacaatgcgcgcaacaactgaatatatgtcttttgcagttctgtattttccggcgcttcacggaacaacgcatcccactcgtcaataataatcaaaaatttatgcccggtttttacactgattgtaagtaatatttccggcaaagaaacgacttcctctgtcacacaatccggaaaggcttcccgtaattcctttccaatgtcacgctgcagattcaaaattgtatcctctatattctgtgcattggaaataaaccacgccatatcccaaaacaggacgtcacaattattacgatatttattgtaccactctttctctttctcttttgtctcctccggcggattggctacgcgcaaatgtgcaaacagttcccccgcatctgctcccttcgaataaaatgcggaaagcatctgtgcagcataagattttccaaatcttcgtggtctgcttgaacacagcatatttctggaagagtttaataccgcattcatataggtaatcaatccggttttatccacataatctccggttttcataatggatgcaaatccatccgcagatggattcagataaattcccataccacgcactccttcctaatatccgtaaatatcataaatctccggcatatatacccccggctctttgtatacaatgagtggtttttccaccgtcagacgggatttgccgccccgcagcccctctatcagcaccatattcggctccttatccacaaacggatagaccagccgcatgcgcttcggctcgatatgatatgccaccatcttactgaaaatttccgcaaggcggaagggcctgtgtaccatgtaaaatcgtccgccctgctttaacatctttgcgctttcacgcaggatatcatccagatcacagagaacctcatgccttgcaatcgtcttggcattggcatcattctggattccatgctgcccgatcatatacggcggattcgttgtgattacttcaaacgatccggctccgaaacgcgcagaagcctccttgatatctccggtcacaatcgtaattttctcttccagatgattgtaggcgacgcttcgcgccgccatatctgcactctccggctgaatttccagcccggtaaaatgttcccctttggtctttgcctccagcagaattggtatgatcccggttccggtacccagatccagtgcccgttccccgggctttactttcgcaaagccggacagcagcactgcatccatgccaaaacagaaccgtcccggatcctgaatgatccagtagccgtttctatgaagttcatccagtcgttcatgactgtggattgtcaccccgtttttgttctccacgttcgttgtttccaccctgataattctttctgtcgtagtttcgatgccgccggaaattccgctctccgcggtattcgcgtttttctccgcccccgccactgttttcacggtcggcattctctccgcggtcacgattatagtttctgccacggtaattgctgcgttcccggtactctcgtttctcaccgttttcattctgctcgcggtactcgcgcttttcgccgcgatccctgtagtttcttccacggtaattgccacggtctttgtactcacgtttttcacggttttcacttccggcatctgtctctggtgccatacgttcctgtgacgattctccggcaggcgcttcatttttatcccgtgtatcattccgctctctgcggtatttgccacggttgttttccctgcggttctcccgctgcggacgttcgttttcttcctccgtgcttccgttatcctcaagcccttccagctctttcatttcctcatccgttacacggacatccctgcggcgccgcggtgtaaacttcagatcatctactgcatattcctgcagttctttttcttctccgttatccacaacaaccttaaccagctgacgcagtacattaacaccggacacttctccatgcattccggtcggtgtgattaccgaatctcccaccgacggcagacggctgtttaagtattcgtatgtttcctgctcgttcttcagacaacacatgagtctgccgcatacacccgaaatttttgtcggatttaaggacagattctgttcctttgccatcttgatggataccggtacaaaatcggtcagataggatctgcagcacagttccctcccacagattccgataccgccaagcatctttgtctcatcgcgcacaccaatctgccgcaattcgatacgggtgcggaacaccgaagccagatccttgaccagctcacggaaatcaattcgtccatctgccgtaaagtagaacaaaagcttattgttgtcaaatgtatattccgctgcaaccagtttcatatccagcccgtgctttgcaattttttccttgcagatcacgtaggcttccgcttctttttctttatttttttctataactttttcgtcatcgtctgtcgcaatacggatcaccggtttcaaaggctggacaaccttatcgtcatccacctctttgggtgggatcagcactgttcccatctctacgccgcgcgccgtctccacgatgacgtgcatcgccgtctccagatcataatccagtgggtcaaaataataaatctttcccgcacgctgaaaacggattcctaccacttttatcatattaattctccttaattgtcagtaacagcagctcaatcacaagatcgaaatttacatttgccgaaatccggactttcgctgtctcaagtgcacggatgatcgtctcaattccctgatacgaccgctttgctgcctgtttttttatgtcataaacctcatccttaaaaatgagtccgtttacatcattggttgctttcatgtaaagtacatcgcggaaccagatcatcatgaggtcaaaataatcattgactgtcagcttatactctgcaatctgctttactgctgctgtcatttcatacagatcaatatcttccagacgcttcatcagctgcagcaccgatgctttcagttccccaaattcttcggaagatgccagctgaatggccttccctacatttccctgggaaaatgcggcacagacatctgcctggtaatccggaatgtgatacgttttcatcaggtaagatttgatcacatcttcttttaccactttgagattcagtgtaatgcagcgcgataaaatcgttggcagaaaactgtccgcatttgtggtcagaagcaggatgacagcatatgccggcggttcctcgattgttttcagcaatgcattctgtgcctgctggttcattttttccgcctcatccacaatatacactttgtagcggctgctgtatggttttatcacaatatcgttattgatctgggtacggatatcgtccaccccgatggtattcggcttttcgtgggatacatagatgatatcgggctgattatgatccaccgcctgtttgcaggagcggcataaaaggcatggtcttgtcccttctccctcacattgcagtgccatggcaaaagcctctgcaagcatcatttttccggaaagctttggtccgttaaaaatatatgcatggctgactttgtcgagggcaattgcattcttcaaatgcccgatgatctgttcatgtccaatgatgtctgaaaatcctgccatagccatcccctccttgtatctgtctaggtcaaaatatcaagcaaaagtcctttaatttccccaatacggtccagaatcgaaatatgatccttttcgtctgccaccagttcgcctgccagttcatccagattcttatcgatcaggcggataatgccatatacccggtggcgtcccctgcggtcaagaaaattttcccttgaaaaccggtgggaacggtaaactacttcattcagaaagtcttttatcagtccacggtactttttcatatcccggatgtccatgtgctccgcaagacggtttccctgcgccgtaatatcactgagcagttcatccacttttgcctgcagatctgcatctgtgatcgcacttgcaagtgtaaacttgaacgagccgtcgccttctactgtttttgtggcctccggtacctgattgaccgcggatatatcgtttacttttatcgccatatagaaatcctcttatcctgtttctccatcccggacatatcccgccggatatattccgtgatctcccggatggttccttccatatccttatttataaaccgtcgtgtgatgcctgcctctgtcagcttttcctcggaaaaatcggctgcatccgcaagaaatctccggcacatttcctcatactgcggagttttctgctgccgctctctggcaatcgcccgaagcagccgctcgccatcctccacttctatataaatcggcactacctgtgagcttccaaagtatctttgtattttctgatacccttccagtgtcacaatatacagataactgtgcgccgacaggtcaattcttccatcatctaccgtaaaatatttccagatcccatagaccgtgtgatatgcccgaagctcgatcaccttgcctgcgctttccagctgctgtacatgtgtctcatctgtaaatacatattccctgccatccatctctccctccctgcgggggcgggtggtatacggtacaatgcgtaaaagtgcaggattcccctgctgcataatccggctgtagatactgtcttttccggaagaactctttcccatgacacaataaattttgcccattgatctctttcctctagtataatatatttgccgtcatttcacaacgtttatacacgtcaaatccggcagtccctctacctccaggcccagccggatacaatgccggatcgtttctgcggtctgcacgtcaatcgcttcgccaggcacaagaatcggaattccgggtggatacagatacacataatccccgctcaccgctcctgtggcttcctccagccgaaccgttttttgttctgcgtccagcgcctgatcaatcgtcatgacggttttttgttcccggtaaatctcccgcggtgaaatctcgctggtctcttccttcttatggaccgttccgtcaatacattccagtgcatccgaaagccgcgcaaacccttcgtccgtatccataatggaagtcatggcaactacatagtttccgcttgccatctccatctgcagaccatattcctgcagcaatatctcctgaagggcctgtccgctcatgctgtttccggtcagaatcagaagttttcccggatcaaatgagaacgcctcctgttttgaaaaatcggagggctgtaatacctgcagtgttttcagatttttggtcttatcccgaaactctgcaagcctcctgctgtatgcagcaaacagcatttcccggtctttttctatgatctgcagacttttttcaatccccgccatcagaaggtatgacggagaacttgtctcataaatccccagaaattgtgcgacctttttctccgcaatccggtcggaacacagatgcagcaatgcggtctgtgtaaatgcgggaagtgttttgtgtacactcataatcacggcatccgcaccaagccttgtggcattttccggaaactccggggaaaacccgaaatgcgctccatgcgcttcatccacaatcagtggaatcccatatgcatgcacgatgtccgcaatgctttggatatccgatacgaccccgtcatatgtcggggaagtaatgacaacggcccggatatccggtgtctgttccagctgctttcgcaccatctgtggtgttacctgcccctggatgccgcaggcggtatcttccggatagatataaacaggaaccagctgccgcagatacatcgcgtgatacaccgctttgtgacagtttcttgccacaaggatttttccacccctcggaactgctgcgctgattgccgcaagaagtccgcaggtgcttccgtttaccagataatacgttttttgtgcaccatacagatctgccgctttctgctgcgcctcctgcaggattccggttgcatggtgaagattgtcaaatccctcaatttccgtaatgtcaatggcatagggattggcaaaaggcaggaatgcacgtttatgccctggcatatgaaacggatagatgtccgattgttccagttcatttagtttttgttccagcatatttcctccctatcccaagaaccggccaagttccggcatccagtcatcaaaaaagatctcattgcggcaaagactctcccagatcggggacacaaacaccagaatcagattgattgcgtcttcccagggaacctctgccagcccatggttacgcagatacttttcccagcgcttgcgcatatatgtgtaagcccggtattcgtccagctgctttaatctctgctcttttcgcatcttcggagatgcagcggtaagcaccgtcagttcctccagcacataacgcccgctgagcggctgtgtccggagcagccggtatgcatcataataacttcccatgctgccgatcagttccagcttgtccatgatcgcaaacagatcatagctcagttcactctccggcgaatacaccagataggaaattgttctgcctccgcccactgcaatcagttcttcttccctggttcccggaatctggctgaccgcaccaaaactgtagatctcaatatttagcggaactttcatatcaaaatacccggcggtcatgctaagccggattccgccgctcaatgccgtcaccgtaccttcccaatggattttctgtgcattttcttttgcaaaaagtgttgttttgatatgttcgcccattgcgatggataatcgctgaccgggctgcagtttgtccggcgtgagttcttcctcacttcccttataaaaaaagcggatgcgcttcttggcgcgctgccggtatgcctcttcccccagaagcggcaggctcatcagccataaaaattcacggtatgcagacgtactgacacgcagcatcagatcttccaccgcatatccccacaggagatccgcaaatggaatggagagcatttcgcttctctttttcagttctgttgcctcacatacaccgactttcattacagccacactccgatcagactctgtacctttcctgttacttttcgcgctctggcatattccatcagcatggaaatgtctttatcattgtcccggatataggactggaccgcctcccggaaaatcgcccggtcaagctttgcctcatatttcaggcagtcacagatcatacgttccttatcataaatcagaaacgtcagtccattctgctcaatcgttgtggaaccaagttccaaagcttccggctctgtatagtagggaattactttcggataatccatcttaaaccgcgacttggacgtatttttatccaccgccagatgccatccatacggcttttcccggatataaccatacgcatagagtgcactttccatgcacagacgcgcatccggaaacagccgtgcgatcagttcttcctcggaaaagcggtcgatccggtcggtataataaccgttttttatccgcaccaatgtcccggcttccacaaattccagaatcttgcggtaatccacatcaagtgccgcaaattcttccttttttacgatgccgcctttttcattaataaaagcgcgcagtttttccaatgtttcttctgatgatttactctttttcgtatttgtcgacattttccgctccataaaaattaacgtggtatttcacttcgtattctaccttttcctgtggaattcgtcaagaaaatagtatatagtaaagataatctgaaactgtaacaaaggagatcccattttgaatcagaaaaaccagctgcgcaaaaatccttcccgcgagacatgcgaaagcatcattcgccggattctcatgaccgaacttacccaaaacggaaaaaaccggcactttcgaaaagctgccgattttatgagttattttgaatctctgtatccggcatcggatgccctgaccaaacaggtgcagcgcgccgtccagtctttgcatatgccgaaggatgccaatggattttttattgtggacaagacagctgcacaggtggaacaggaacaatgccttgggaaattatttgcagatgcaaatgtctccctccatccaatggaacaggtagagaccgtttttctgtccgtaccctcccatatgcaggaacttctgctgcatacattcgaacagagtgatctctttgccggacagattcttaccatcgttcgcaccggtaatggtctgttaatttacaccgaagacaaaaaacagctactttcattattaaatcgtctgataaatcagcagtaattttgtaatgtcgtttatgcgtcaattttatagtttaatgcctttaatttgtctttatttcggtttagtacctttatttttgtctttttgtacatttctgtcctttatgggttaatgtaaagcatgccggatgatccactgttcctccgcggataaccggaacaaatccatgattctgcaatccagccgtttctggcaagtctctgctgcctcttttcccattccacaaatcagcggctcggtcatcgctataatttcattctgtatcgctttcccaacacgcggaatcggaatatgctccatatgcgcccgcaatacttttatggaatggaattccttctgataaacaaactgagaaacactggaatttaaaattgccagaatatatttgatctgcattccctcgatctttgggatcacaatgttgcagctattcaaagaaagcatctgccggtcatcataagccaccaccagctgattgctgataaaacggtacaacagtttttccggtgcccggtatatctccagaggtgcaacctgctgaaactgctccggttcaaaccgcagatactgttttaccggatttatgtggtatttgcaaatatctgtacctttcagtaccatctccgaattttccgttttctctgcggagagaaactttttgttgtttccggtaacaatgccaagtgcaaaatctgcatgatcggccagataacagacgggaatggaattttttattttctccagcacacgatactcttcatctgtcatccggaaactgaaattttccggcactaccgtccgctccatagcaatggtatatgtacgtgtccggtcttctatcatcatacctgccgttgacaaaggctttccggtcgcaataagctgcaacaggatgcagggacactgtaccccgtcaaacatatctcccagaaacgtaagggattttacagaacttctctgaagcagaattgtgcggatacgcatatgtgcctttacatttaagaccgcttccggcagcacaaacgccagcgttccatccggaacaagaatctccagtgcccgttcgataaaaacatcataggactcggtatttcttccggaagccgtggcatatctggcctttaacactgctttgtcttcattggaaaaagcatagccccatggcggatttccaatgatggtatcaaatcctgttctgtcatattctgtgagaaaattcttctctgtaatatgttcgcagatctcctcaacatccgcgtccggatatttcagagccatattgagtcgtgcgatacggatactcaccgcatcggtatccgtgccataaatatctgccagatccacactttccggcagctgaagcaggaaatttccggtgccgcaacacggatctaacacttttcccatatgttcgatatccagatgagaaatcagcttttttacaacttttgtgggtgtataatacgaaccgcgcgctttccggcttcccatatttttacaggaaagatatataagtcccagaatgtcttctcccggctcccagatgtattcatgtgcaaaaaatgccggatatttttgacagaaatccattgccctttgtctgtcaccaatcaatgcatccagtaagatgtcatatttccctatagaaattttcccctgcagatattggaaaaacaatggtttctgtccgaataactgcagtgcaccgtctgccacaaaataggatatcacatcagaggtcagcagaatttgttcccgtgttatctcggagagcagtttctgcaaaacggtaaggttcttgcagttttgggaaacataagaacgatataacgcatttccggaaacatattttttatttctgcggctttttaatgccacattttttcctgaccggatttcattttctatgattgcaatatgctttttatcaaaatagggcaccccgttttttatatattggggagttatctttccaagttttacccagttacgaccggtagcagctgatatggataactgctcacataactcttttaacgatttgtcatgcaatttcaaattctcctggttacctgctttttaaaaacgcccggcagtcggaagctgccgggcattttctgtatttgtcgacattttccgctctgtaaaaatcaacgtggtattttacttcatattttacatttcccagtaatattagtcaagaaaatagtatatcctataaaatctgcgcaccgttttaccaaaaaaggaagccgattttaaacaggcttccttttcgtattcgtgaatcgcttttattttgtaattgcatttacaaatctttttgtaatttcccgtggtcttgtgattgcggtaccaatcactgccgcatatgcaccacacgcaaatgctttctgtaactgctgcggctcccagattccaccctctgcaatcagcggaattgtcaaatcctgtgccagcttttctaacattggaaagcacggaatttctgtacctttggtatccggcgtataaccacaaagtgtggttccaacaatgtcaaacccaagtttctgtgcacgcatgccatcttcataagacgcacaatctgccataaagatcatatccggatactttttacgcacttccgggaaaaatgtttctatggtgcttccatccggtctttttcggtttgttgcatccaatgcaataatatccggtgcggctgtcatgatagcatcaatttctttcatggttggtgtgatataaatttccgaattatcatagtctactttatataaaccgatcactggaagatccacttcctttttaattgcaataatgtcttccggtgtatttgcgcgaattccaacggcaccgccttcttttgctgcaaatgccatcctcgccataatttttgaactgtaaagaggctcggtctccaatgcctgacaggagacgatcaaaccgccttttattttatcaaatacattcatctcttatttcctcctttttgcaaattctgacaaccagataggatttgtccatgccgtgtgcccatgttcatctatacattctgcacgaatatatgtttcttttcctgttaacggataaaatgcttctgtcagagggactccatgttccgccaaccgggtcacacccaaagctactggtccgccaacaatcatattgatgcgttctactgcactgcaattaacgacaaactggttattttccaccttccagtcatatatttccggtcctgaagaagaataatattccccattcaaaattgcctggcagattgcttcatgggaaagttcttccgcctgcacaacaatatatcctccaaaagaatccggaaaacttcctccattatgattatcatctgtcgcatccgcattgatatgcctgccactgcgaagcatcagatcccaataggtcacatcataccccgtaccacactcattaacggtgttataattaaaaatctccaacatattgatatccagaatattgataaaatcttccggccttacacgtgaccagattgggtgattataagtcacgatacaaccatgattctttaatctctctgcaagttttttccctgttttatttccatcccagtccgtcccgtaataaatatcaggctctactttttccatatgtgaaaaggtactttccaatgcacctttttgcatgctctctgttccgagaattccattcatatgatgcagtctgaccgtatttccctcatcatcaaacaatactgcagtagcctccacccccggaagaataagaaaattcttttcccccagctcccgacggtaatccgtataaaaatcgcccctttctgaaagtacaatccgggcatcttcccatccacggaaactactttcaacaatcacacgctctttcctgctgtatgcaataatatacggctcctaccatacctgcctcattcttcaatgcagctgcacagatttcaagatcttttgcaaaatttggcatcacatgtttcatcacatatgatctgacaggagcaataaaaagatcttcctgtgcagaaactcctccgccaattaatatctgctctggattaaacatatgcacaaatccaacaagcgctgaagcaatcacctctatccattcctgcaggattttctgcaccaccacatttcctgtcgctgcctgtgcaaaaatccatcgtccatcaactggtgtatctgctgcccctgcaatcgcaccttcctgtattgcccaacggacttttcgtaccagtgctgaagtcgatccataatgctcaagacatccccgatttccgcaagtgcacatttccccttcatactgcaccggaatatgtccaagttcacccgcaaatccacttgctccgagcaaaatctttccattcatgagaatgccgccacctacacctgttccaatcgtgacaacgacaacatcttttttgccctttgcagcaccaatccacgcttccccaagagccgctgcattcgcatcattaagcacttctgtcggaatatggaattcctgctccatcacctgtcgaatcgggctgttgatccagtttttaatatgtcctgcggttccttcgaccactcctttttttgtagagattgctcccgttgctgacaccccgattcctgcatattcagaagcattctcacgatatttttccaaaaaattatggcagctcttcactaccgtctgcaaaataggtgtttcatatccatcaaaatttacggcataagtttctgttgcatgaatcgtgccatcttcatctacacttccaatctttactgccgttcctccaatatcaattccaatatacttttttttattcatctttatcctccgtgtgttccccttttgcacgaatagcagacagggttgccttatatttttgtgttttaaagtaagaatcatttgcaaaataataagagtataaaacatccataattgctaaaatcgaaaattgcggtgaaatttttgttcctgtatccagattttttaatgctgctacctgaattacttcctgcgattcctttgcaacggatgacccggaaactgctgttatgcatataatacttgcacctctgcttttggcgatccgaatactttctaacacttctgccgtctccccacttaacgtaatggcaatcacaagtgtttcctcccccgccagtgctgcacctatcttcatcatatgggaatctgtaactgcattaacatccatcccgatacgcatgaaacgcagctggaattcttccgctgcataaccggaatttccgattccaaaaatcagtacacgtttactgatgttaagcattcccgccacccgccggacctgctcctcatcaagaatccgaaaattttcctgtaacagtttctggtacgaattttgtacgcgacgcgcaaacaatccgacatccttttctgttccctcgcttttttgttcaaattttaagtctctttcataagaaaaaataaattcccgatatcctttgtatccgcacttctgggaaaaccttgacaaagtagcctcagatacatacagcacacgggatatatttttagaagaaaaatccatatcatctttattaccaataaaaaaatctgccacactgcgttcaaccgctgtcatttttttataggatgcttctattgtctgttttgtctcattttgaaatgagatcatataatcatcgttcatctgttctccacatcatcatctgttccatatatctttccacatataacgcaatttcctgctgcgtcctggcacccggatgcccatctgttcccatgccattgaccggattctgcaacggaagcttcagaaactctgtgccacatcgctgcgcggtttcctgtactttttcacataatgtctgttccatcagaccataaagcagaagtattttcgcatcagcaaaaaccttcttcagctgctgtataaaatccgtatatttttctacaaacgcacgctcgcgggaaggaatctgcctcacataacttgcatcattcgtccccagattacacacgatcagatctggaacttcgttttgtatatagggaaaaatttcgggaagaatgtttttcgtataaggtgtatcctgctccggggcaatccagcgggataataccccattcccactatatgcaacaatcctgctgtctgcatgaagcatctctgctgcctgatatgcataagttttagtcacatcttcatccgctgtccggaatgtgctaatcccatttattccatccactccatatccagcggtaagcgaatctcctatgaaaagcaaatggcgggatggaattgcatctcttgtaaccggggcatccgtaataagatttgtgatccacacattgccatattgttcttccgtcagtttcaccaatcggatcctgatggtttcggctgattcctgctggtaaattatatattttctctttcccggcactgcccggattttttgccggaactgcttttcgtcatttataaaaaccccaataaatgcatcttcctgtgctgcaatgctctgtgccgccatttccacggtaacaacgcttgctgccgttacaaatgcaatcccagatgcagaccagcaaaggtgtaaccctgacggttctttgtttgtaattcccaatattctcacttgttcccaccataccattttctccacttatgcctgccttttttattttacatgcaattatagcgaatctacctataaaatacaatctttagtcataatttctgaaagtagtttccgcaacagttcctatacttccttatatttgtgttttcactccattttttgatagttctttccgttttcttcaaagatatagctttttggggtttttaattctataattattctcaaataaacgagaaccataacaaggaggacatttatgagaatctacaaaacaaaaaattatgatgaaatgagccgcaaggcagcaaatattatctccgcacagatgattttgaaaccagaatcagtacttggtctcgccacaggttcctcgccaattggaacttataaacagctcatcaattggtataaaaaaggggatctggatttctcgcagatccacagcatcaatctggatgaatacaaaggacttgacgcatccaattcggaaagctacgcttatttcatgcgtcacaatctttttgatcatgtaaatatcaaaccggaaaatacctatattccaaatggtatggaagaagatgttgataaagaatgtacccgttacaattccattatccaccagcttggcggcattgatttacaacttcttggtattggtaacaatggacatattggctttaatgaaccatccgatacatttgcaaaagaaacccactgtgtagaactgacaaaaacaaccattcaggcaaatgcccgtttttttgattccattgatgaagttcctactcacgcatatacaactggaatcaaaaatattatggaggcaaaacatatcctgttaatcgcaaatggagaaggaaaagcagatgccctgtatcagtccctgtttggtccaattactccccaggtgcccgcatccatactgcagctgcacgatgatgtttccattgttgccgatgaagctgcactatcacgtatcattgaaaaaaatcttatttaatatttattgcttttgtaaaggagttccttatgattataaaaaacggacttgtctgggaagaaagcggatctttcctgacaaaagatttgcatattgatagcgatacccatcgcatcgcaatggatgctgctgatacgacagatgacaccattattgatgcatccggtctgtatgtaattccaggacttgtcgatatccatattcacggtgctatgggatgtgatttcagtgacggcagcgcggaaggacttttaaaaattgcaaaatatcttcgttcctgcggcgtaacagctttttgtccaacctccatgactttaccggaaaaccagttgctgacagcctttgcatcgacgcgcgaaattccagatgacaatagccatgcttttatcgcaggaatccacatggaaggaccatttctctctcctgaaaaaaaaggtgcacaaaaagcaagctatcttcgcgcaccggatatcgatatgttccgacgtctttcccaggcatgcgataacaaaatccgcatcattacgattgcaccggaactttcaggcgcggatgcttttatccgggaatttcattcccagctgaccatctctctcggtcattccacggcatcctatgaaattgcccaaaacgctttcgctgcgggagccagtcatgtcacgcatttatttaatgccatgccaccattgcatcaccggaatccaggtattatcggtgcagccactgactgcccacatgccatggccgaaataatttgtgacggcatacatatccacccatctgttatccggaatacctttcgtatgtttggcgaagaccgcatgatattgatcagtgatgccatgcgtgccacaggtatggacgatggaacatatgaactcggaggacaacctgtaacgaaaaagggacggctcgccaccttaaaagacggaactattgccggttcagcaacaaacctttttgactgtatgaaaaatgcagtaaattttggcattccacttgctgtcgctgtcaaagctgccacctacaatccggcaaaaagtatcgggttagaacataccatcggcactcttgcgcctggtgcaagagctgatgtccttctccttgatcccgatctgaacattgttcgtatcatataaacccctgttgtaaaaacgcccggcaagtaggaacctgccgggcattttcttatgtactctgtaatttctatctcgggtccggacgatgcttcatatcacggatcggaatattagcaacaagtgccggtaccgttccgttattggaatcggactctgtctcggtgatttttacatcaagcgcctccgcatcaatatccatgtaacgtgagatcacttcaataatgtcattcttcatcatctccatcatctcggaagaacagttggcacggtcagaaaccagcaccagcttcaggcggtcttttgcgacgttgccggaagtctttttcttaaataaatccattattcccacaataagtacccccctctaattcttcttaaaaatatccttcagcttctcaagcattccctgcttctcattcagattcaggaatggaacttcttctcccataatacggtggcagatattggaatatgcttttcctgccagacagttggttccaaccagtggctcaccacggtttgtggaaataacgatctgctcatcatccggcacggccccgatcaggtttactgccagaatatccgttacatcatctaccgtcatcatctcaccgcgttttaccatatccacacgcagacggtttacaatcaggtcaatccgtttcatctcgtttgcctcaagaagtcctacgatgcggtcggcatcacggatcgcagatacttccggtgtcgtaacaaccagtgcacgatccgcacctgctacggcatttttaaatccctgctcgataccggccgggcaatccagtaaaatataatcaaactcttcacgaagttcattgatcagtgcaaccatctgctctggtgtcactgcatccttatctctggtctgtgcagacggaagaagacataattccggatatctcttatccttaatcaatgcctgacggatacggcattttccttccacaacatctaccagattgtatacaatacgattctccaaacccataaccacatccaggttacgcagtccgatatcggtatcaatcattacaactttcttgtttaactgtgcaagacctgtaccaatgtttgctgtggttgtggtcttacctacaccaccctttcctgatgtgataacgattacttcgctcatgaaacttattcctcctacgtccctaaatgttatttaatatatttttggtgattggctcaatatagatatttccatctcttgcaatggcgatctgtgcttccacttccggtgtctttgaccgacggagtgtacgacgtttcggttccggcttgtccggactctttgcgatcagatccccaatctgaatctgaatcggctgcatatccagcgcaaaaataaagcagttacgatcacccatacatcctgcctgtgcgttaccttttaatgccccaagaatcacaatgtttccctgggaaataattttggctcccggattgacatcgccaatgatcgtgacactcgattcactcgaaatcacctgtcccgaccttaaagtgccacgataaaactgctccggcccgtttcctgctgcggcattctcatactgctgctgtacggcatcgtaaaacgcctcgacctgttctttcatgacagcttcctgtcttgttccattttcaacgatacacaggatttcaatcgatgtgttgctttcaattgctgagatgatctgctgttcttcctcttccgaaagttttcttccttcaaaggacaatgccagttttgcatttttaaaaaatgtactggatgctttgaacttttcgacaacatccttcaataactcatcaaacccaatctccgggtctaagacaagattaattccgtatttattactttttatcgtaacagattgtgacatggtaacctccaatttcattattaaaatgaaatccatcaattgtaattatacctgtttgcggcaaatacgcaagcattttcgctttatttgaacgatttaaaaaaacctgtccttcctgcgattgtatttctttcgtttcttctcacgaaaacgcattttatcattttttttcgtttttctctgatgacggatcacataaaaattatcatatgcccgttttgccagaaacaacagaaccactgctgcgacaataaccactcccgcaacaatgagccatgcaggatcgatccgtatgacacgttcatttttcttctgcccgctatcggtattgacgtaataattatcttttacctttgctccggtttttactatatccacactgccgacctcatgaccggcatatgtgtatgcaagccttgcaactttctttttcccttttgcagattctgtctttttataggatgcatcggaaaactgtgctccttttggcataatgatataagcatcctcatccagctttacataaggttcactgttgttcaaaaccccgtaattttttccgttgtcctttgccagacccgcatcgttttccgaaatattcagcgcctggaaattttcaaaacagtaatcaaataattttctggtatccgtataatgatccggtgttgccgcatccatcaccacacacaccagagtaattccatctttctccgcaaaagacaccagagtattattcgccactgtcgtgtagccggtttttccgccagtacagtatttgtacaaatgagagctgtccccgcgaaacgggtagatcattttatggtgattgtgacacggatattccgccttgcatttattggtcttcggaagtgtatagcttggactgcctgcgatcatccggaaagtctcgtttttgtatgcctctgcggaaatcagtgccatatcatacgcgctgccccagtgatcttcatccggcagaccattacagttattgaaatgcgtatccgtacatcccaattcctttgcgcgcttattcatccgatcaataaacgtccggtaatcaccacccagcttctgccccacatgctccgcaaccgcataagcacattcattggcagactccagcataaccgcatacagacactgctccatcgtcagtttttctccaagattccgggcaatatgggaagtatctccctcatttttaaataccgcatccgcagaaaacgtaacgacctcatccatatcacagttttcgattgccagaagaaccgtcatgatctttgtgatactcgccggataatgtttctcgtgactcttcttttcatataaaacggtgccggtattgacttccatcacaatggcacttttggactgcgtttttaccccgtccggccagtactcatctgcacgcacagacaacggtaacatgagtaaaaccgtacatacggcaagaaaaaatgctgttacacgggtgtatttttttattttcataaggctccccaattcttgatttttttacatttataataccattatttccataatcgttcaatttttatttgccgaacggacgaaatttgtatatagtaatagtattcttacagttagcaaaactgaatttatcttttccaaggagaaattactatgagactaagaaatataccgggtgccaatgaagctgtggcagccagcccatattgtatacagaatgcagcagaacaccgcggacaatggcatgccttttttgaaaatgaccatccgatccatatcgaaatcggcatgggaaaaggcagatttctgatggatcttgctgcgttacatcccgaaatcaattatatcggcatcgaacgttacaccagtgtactgctgcgcgcagtccagaaaatggataccctgcagcttccaaatgttcattttctgtgtgaagacgccgcaaaacttccggaaatttttgcaccggaagaagttgaccggatctatctgaatttttccgacccgtggccaaaggaccgccatgccagacgccgactgacttcccatgaatttttagaccgctatgaccagtttcttgcagccgacggacgactggaatttaaaacggacaatcaggatctgtttacgttttcactcgaggaaatcgaaacttccgaccgctggcatcttaatgcctccacccgtgatctgcaccatgatccatccatgaatgaaggaaatatcatgaccgaatacgaagaaaaattttcttctaagggcaacccgatatgtaaactgatcgcctcccgctaaggaggcggtttttccgttatcctacttttccaaaatccgccggtttctgtacttccggtacagccggtaacaaaaccgtgcttcttcctgtgagatctcttcttcggaaaagaccgctttctgcacaatgcacagatacttcttccaatcctccgccggaacggacggataggttgtcatcagcttttccagatagtccgcatcagtcttcatgccaaaacttcgctgatgtaatccccggtaaatccgccggttgatccggtataccgcatgacgattctgccggttgcgcaactccataagcaattgttcccggtaaatgcgcaaccattttgtcaccagaaccagcatcagaacaacagcaaacagcgtcagactcaccgcagaaaatacttgcagatttcgcctgttgttctttttctcattattttttaccggccgctttgtctccttctccgtcatctgactttctgtctgctgctgtgtttccatctgtgtttctgacggcgattcgtttttcgtctgcggattctgctccgccacatctttgtgctcttcatgccgctgtttccacgtatcgcgcaattccggagtcgtcggcagctttgcactgtcattcgtatagcccggagtcatttccaccggcacccatccgatattttccagataaatttccacccatgcatgcgcattgtagtccggcacatctgcctgatagcctttcttttctttatgaaatgccgacggttccaccacatatcccgatgcataacgcgccggaactcccagactttgtaaaatcagcgcacccgcgctggcaaaatgcatacaatatccctcatgtccggtttccagaaaataagcaatggtatctttcccctgtgggatgtgattcagatataagttataggtattttcgttccccagccagttggcaacctgtgtcgcaagattctgccggatgttgttggtagttatctgtctttctgcccgtccggaattgtttccatccgtatccgccagccaatcctcatcgtataacccgcctgtttccatctgatccgccacataggtgccgttttcctcatacacgccatatccgatactttccagagccagccttcgtgtaataaaatctcccactgccggaacatccgtggcaaatttacggtatctactgtcagcataggcatcataccattgctgcagatccgtatctgtttctccgtggaccatacaaaacctgtcaaaaacatcgcgcagatccgtattttcattcagtccctcaaaagaaacctttcccgttgccctctttttacataccaccgtatcatccctgagccagaccttcccaccggctgtctgcgaatctgaaaaataaggcatatacgcgttttttaaccccagtgcccgataggaaatctgatacgaaaccgtctgtgtttcatcctctgccagctcactcgaactgatgtattttataagttcaccggcattctgttgcattaacattgcaacatcactgcgatggtatcccgccttatccacttcgtgcgcaaacgttttcccttcatttacccatgtaccgttctgatatgtgccactggcaaatgatttcagatacagtttgcccgccggggctttcgatgcttctatcgaaaatacggtttttccagtatagtccggtgttgtattatccacatgttcccgcgatccctgcaaagttatccccgaaaacgtcaggtttttcacacgttcttccacctgtctctgaaacgcataaaacttcggtgactttttcggaatctgctttgccacaccggaaaacgcatagctgctcaccgagacaagaatcacggcaaacacaccggctgcagcataggacagtagctgcatccatacatgggtacgaccgtcagacacccttacatccatgtgcgtccatggtgccgcagacaccagcacggttcccacgaaaaagagtgcaattccactccagcccagtcttgcattgaccagaagagcaaccgacaacgctgttatatccggaagcagcaaaaccagccgcacaccggtcacatatcgaaacatcagacttaacagcacaacaactgccaataaaaacgccagcatataagtataccgcatctccgtcccggccccggtcatataatttgttccatactgtttattccaatatgacagatatgcctgaaacagcatttttccgctctctgtcagttttctccgatgaaaaattccaaacagtacgagtgccgccggatatccgatttcaagcacaaccttgcagaccctctgatattttccggtcacaggaactcccacgataaacagcacaagacttaccagcatggccacctgcagtttaccaagcgcacggatcggcagctgccatccgaatgcactccggaaaatcgcaagcattgcataaaacagcagttccacagcaaccgcctcacagatcagccggataccggtattgccagacaaatatgtggttttattccctctcctgtccttcctgttcacaataccagctccatttcttccagcttctgtctccagttatctccaccaaaatccgcaagtgtctgtccatccagcacaagaaaaagctccggtgtcagttccagcctgtgtaccggatgctcgcagcgatactgctgctcatatctctgtcgcagtgaaccggccgtttccttctgacattccataaactgcatcaaaaacagatacacgctttcctcatcctcgacgcgcaaccgtttgatttctgtttcctcctgccatgccacataatgcgggcagccggcatccatcatcgaatacaccagatctgccgcaattgtgagaaaggtttccgcataggcttccctgctgcgcctcatatgccggccttttcctgccatctgtggcagcatgtccagcaaaaataccaccgcacaggcaagcggctgactgtcctcccgcaccagaagcccgtccgatttggcggagagtttccagtgtatgcgctgcaggcgatcccccggacgatattcccgcacatcaaagatctggctgacatctgttcccggctgaaaatcatcgtagctttccgcttctccgaaatatctgcgtacccgctccgacacctgtactgccacagcatccagttccggcagcacctgtatatctgcaaatctctttatttttttatgcacataaaacagaccggtcagatcataaatccgtacttttacaagctcatactcataacttcccacatgagaaagcacaacacgcttttccatgcactgcattccgcgcatcagtccggcaccgttccaccagaaatttctggcatacccggcaaatgtatttctacagcgcacacggtaacgcacttttgctgccggaaacaacatggtctgatccacggtaagctgtaccgtaacttttttccctttttccgccacggtaagcggaatcctgatatctgccgtgatatgtctgcaataaatcagcagatacaaacatgcaagcagcatcagtaccagttccgcaaacccaatcagcccaatcgcaatgcttccatagatcagcgcaatataaaatgtgacaagcgtcacccctgttccaatcagaaaactgcccacgtttatcccctaagtcttttgtatgttgttggtttgtccacatccgacagaatttcctgcagggtggcatcgacagttacatgtccgatccgtgcctttgtgttgagcacaatacggtgttttgccacatccgcaaaaatgtccgtcacatcatccggaatcacataatttcttccctgcaaaaatgcccatgcttttgccagccgcacacatgcgatcgtgccacggggacttacccccagctcaatgtaagcattttttctggtagcctccatcagctgcacgatatattttgcaacattatcatgcacataaatctgttccacatactgctgcatctcccacagctgctctggaagaagaaccggctgcagatcctccgctttcgtcatcgtttttccctgggcaatttccatctcactctgcagatccgggtaccccatgctcatgcaggtcatgaaccggtccagctgtgattccggaagaagctgcgttcccgcactgcctttgggattctgcgttgcaatgacaacaaacggctgcggcacttttcggctcacaccatccaccgttactttgccctcctccatcacctcaagaagtgcggactgtgtctttggcgaagtccggttgatctcatccgcaagaaacagattacacatgatcgttcccggatggtacacaaactgtcccgtctctttctggtacatgttaaatcctacaatatctgccggaagcacgtccggtgtaaactgtacacggtgatccaaaagtcccatgacgcgcgaaaaggcgatggcaagtgttgtctttcccacacccggcacatcctcaatcagaatatgccctcccgcaagaattgtagcaaaagctttggtaatacaggcatccttccccgcaatcgcgcgtttgacctctgccagaaccgcggctgcatactcatatactttctccatatttccccctatggtttctttctataattgtttgcattttatataataaaaaaacccccaacgaatcacattgttcgtcaagagttcttttgccatttgattcaatcaaaataagctttgcgagtgcgcgatcaggggttcgaaccctggacaccctgattaagagtcaggtgctctgccagctgagctaatcgcgcatttttaagttgtttgttttgtgtctttccttaagacaagagttattatataataggagtattaaaaaagcaagcactttttttattttttttaaatttttttaaaagcatatttgaaaggaacaatttaacatgaaagtagaagaaagattactaaaatatgtcagctattggacaacctccgatgaatcctgcagtgacattccaagcagtgagcgtgagttcacgcttgcaaaagccttaaagcaggaactggaaactctcggtcttaccaatatactcctcaccgatcactgctatgtatatgccaagcttcctgccacaccgggcatggaaaactgtaaatccatcggctttatcgctcatatggataccgccccggatttttccggaaaagatgtcaaaccacagatcattcccgactatgatggcggggatatcttattaaaaggaagtcaggatgtcttaaaggtaagtgattttccatcccttgcctctttaaaaggaagaaccctgatcacgacagacggtaccacacttctgggcgctgatgacaaggcaggtgttgccgaaatcatgacagccgtggaagaactgattgcagaaggtacaccacacggggaactctggatcggatttacgccggacgaagaagtcggtgcaggtgcggatctgtttgatcttgctatctttcaggcagattatgcatacacagtggacggtgattacgaaggcgaagtggcttacgaaaattttaatgccgcaagtgccatctttcatattaaaggtgtaaatgttcatccgggcgaagcaaaagacattatggtcaatgcggcactggtgggatgtgaaattgtttcccggcttccggaagcggaaacgccggcgcacaccagcggacgggaaggattctatcacctgaccgatatgtccggagatgtggcttccgccaccctttcctttatcattcgtgaccatgataaaaccacatttgagaaacgtctgcagaatctgcgtgaccttgcacaatccatgaatcagaaatatggaccggaaaccgtcacgctcgacatcgaacattcgtatgagaatatgatctctgtcattgaggataaaatggagatcgtggatctggcaaaacaggcaattgcctccgaaggtctgacaccgctctcccgtccgatccgtggcggtacagacggcgcaagactgtcctttatgggattgccgtgtccaaatctcggtaccggcggttatggtttccacggcccatatgaacacatctctgtggaaggtatgcagaccgctgttcgtattttaaaaaatattgccacccatccgatccgtaaataaatttataaaaaaccgtccgcagttttctttctgcggacggcttttgttctataacttattaaattttttaattcccctgcatatttgcagaatttgcaagtacaggcttctggaacatgcgaaagagtccaatctgttctaaggcctttgtgattgcgaaaaagatcaccgaatcaattggccacataatcaggttcttcagcgcacgcgccggaagaagcaccataaatgcctgtccatataacacattcagacaaagtgttgtcagaatcacgttacagaccagcataactacaaatttagctgccagcacacgccagatcgtaagctttttcttataaaaaaagcatccatacaggattccggccagtataacaaccagcgtcagctgtggacaaaatggtccggttggcttcatcatatacttgataatatccaacgcaccatggaaaattcctccaaccaccggtccaaacagataatcaatgataccatttggaatactggaaaaaccaatccgaataaactgcccatattcaatggagaaaaatcctagaatgacagcaactgcagcaagcattgccatggtggtgatggttcttaccgcttttaattcacggaaagaatcggtgaacaaagtaacgaattttttcataaaaaaattacctcctttgcagacctcaccgtactacaactggagataatattatcttcggatgcagcgggatgcgactcatgtaccgcaagattctcttttcgtccgggtgacaactccctgttcatccggcacttaacgcacatgtgtctactctgctttaaactattaaattgcaacgacctaagtataacacaatgaaaaagaaatgcaactattttttttatggcatttttatagcaaaacgccatctgtcacacgtttttacgtggaacagatggcatccgttgcctgttattttattcttttcaggttcccatacttgcaaacagggcagctatctcatccgggcttaatgccttattgggatctgccggttcttccggctgaagaggtgcttcttttacggcttccggctcttcaatcggctccggaatatcctccggttccaccgtttcttcgacaggttccccggctttatccgcattgtcgtcattacccatatttgcaaacagggcagctatttcgtccgggctcatggcgcggtttggatcggacagatccggcatcggcgaaagttcttcctctggcaggttctcatcatccgcttcatcaacgatcgcatcctccggaatcggatccggctctaccagttcctctgcttcctcaatggattcttccgggtccggcgggataatctcatccgctgccatgatcggaggctcttcctccggctttaaatcctcctcttccggtatatccggcagaatctccggttccatatcttcttccggctccagcgaaatctccggttccagactctcctccagatccggcaaaatttccggttccgggttttcttccagatccggcgaaatctccggttccgggttttcttccagatccggcgaaatctccggttccgggttttcttccagatccggcgaaatctccggttccggctccatactttcttccggctctggtgagatctccggctctaccggtgtttcttccacatgattctgcggtgctggctgtggctctacaggtgttgccacaggtacagaaacctgcggctgggaaacaaccactttctgactgttcataatggtctgattcaggcgcagttccatatctttcattgcaataatgatttcctgcagctttgcggctatctctttatcctgtgaatgttcctgttcttttccatccttctgcaccgaagaaatttcatccttacagactgaaagaatctcgtccttataagcacccgcaactgtaccgaacccatccattcctttctggaacgtatcaaaccggtcgatcagctgttcgtatgaattcatcaatgcatcggtattctcatgggaccgcttgataattactttcgctattcccttctgtgcattaacaatttcctctgtcggaatcttagatgcctcttccatatatgcaagcttcaccgatatttcctcaaaatattttttcagcatgagatatgatgccttttccgacttgaaaatactctcatactgttcctctctccgggcatattttgtctcatatactgaaatcacgcctctgattgcaacatacaggcatatcagatctgctgctgccaaaacaaccagaacaataaacatcttcgggaaattgactatggcatacaactctgccataaaaataaacgcaaacaaaagtatcccgaaaatcatctgcatccttgctttcgaatctttattcttcatatgataccgctccttccatgagcccgctattctaaccactatgcaaaataagctctagtatgttatattttaccatattgtgtcgattctcacaaggtttgttgtttatttctgccttctataatacgtcatttacaatctgctctgctgtcagatgattctcttttaatacctcatttacatcataccggtcaaggaattcttttttcaatccgtaattatagactttcatatcactgcttccataaaatcttgcgattttttctccgaaaccaccattcaggatgccatcttccagtgtaactaccgtgtcatggtctgccttcagcttctcaagcagtccttcatccagtccggtaatataatacgggttgattaccgttgcatgaataccttttttctccagcatttctgcggtctgcagtgccaggaaataaaatgttccgagtccgatcagtgcaattttgcttcccttttccgttacctcataggtgttgagctgactccagtcttttttgacttctctgccatccgaaatcatgtctccgcccggaagtttgatcgcaaccggcatttccttctgctccacactccaatcaagcattgacagatattcttcctttgttgtcggtgccagataaaccagtcccggaatattggaaagcatcggaatatcctgcagtcccagatgggtaacatccgtcatgccaaataccgatcccgtatacacaacaatcgttgccggattcccgtcaatacacagatcctgtgaaatctggtcatacgtcctctggataaagctggaatacacaccatataccggctttccgccacctttggcaattccggaagcaagtgctaccgctgtctcctccgcgattcccacatctacaaactgccggccggcctgtttccttttctcctgcgtaaatccgagaatcgtcggggttccggatgtaattgcaacaactgtcggatcctgtttcatcttttcgatcagatattcacaggtcaccgaagaataatcttccacttccggaaaatgggattttccagtctcaatatcaaacggaagatgccagtgccattcttccttatgctcttctgccggtttataaccttttccctttaatgtattaatgtggacaacaaccggtttcttactgtcttttacctgtttgaaagccccgatcagctcccttaagtcatttccatgatccacatagacataatctagtcccatggctttaaataaattgcactctgcctgtccgtttgtctcgcggagtaatttcagatttgaataaagtcctccatggttttctgcaattgacatatcattgtcatttactacaatgatcatgttgctgtctaattctgctgcaaaatccattccttctaaggcttctcctccgcttaaagaaccgtctccgataattgcgatcacatttgcactttccccacgaagatcccttgcctttgccagaccgcatgccagactgacggatgtagaggtatgtccgaccgtaaaatggtcatgttcactttcctgcggacagctgtatcccgtcacgtcatcgtaatgttcttcatataaataggcatcttttcgaccggtcagcatcttgtgcggataggtctgatgggaaacatcaaataccattttgtcctttggggactcaaaaacataatgcagtgcaatgattgcctctaccatgccaaaattcgggccaaaatgcccgccgtgaatacttgccctctttaataatgcatgacgcatttcttctgcgagagctgtcatctcttctatatttaatttcttcacatcttccggtccgttaatcttttcgatatacatataataaattctccttccgattttatctatcataatataccacttaaagttaactttaagtcaagtattttttatttaattttcaactttttgcttcaaatcctcaattgcctgagccactatacctgcgttcttaaaaagatgtaaatattgtaatgataaaaagggcaaaaggtatcatttcccactgaaatgcaatttttatgtcattcgcatttcttgcgatccgcttgttgttccgatataattatgctatgattgtgctttgattggaggaaaccattttgagcgaatattataagttttttcaaaataaaaaatgtgaatattttccatgccataaaggaattccggaggcggactttaactgtctgttttgttattgtcccctctatacactcgggaaatcctgtggtggaaactgtgaatatttaaaaaatggtatcaaatcctgcataaactgtggctttccccatcaccgaaagaactatgataaggtcacgaaccgctttcaggaaattgcagccgttatggcagcttccgataaggaggatgtatcccatgaaatgtaaacttactcccggattatcctccggtgactggaacgaattttgcagccgtttccatttccctccggatgacctgccccatattcaggcaatttatacggcacttcttcccctggttgaatcctatgcgtattactctctggatcaggatttagacggggtttccctgcctcactatgcctatgggtttgtgacgcttggaaacggagtggatgaactgtcggaattatatctgaaccatgaacagatccaggaggcttacattgtggactgcatcagcctgatgcttttgtcaaaggcttatgaagagtttgcacatgtggtagaacgtcagagccgcctgtatcttgcagaattatcttttctgggagatacctattcccttgacctgctcccacagatttatgggcggcttgccccggatggcatccggcttaccgaggggcagatgctccggccgcttaagacagcaacactgatcctgcatctggatacaacaacacacgccaatctcaagcaattgtgtaatacgtgcgcaacctgccggaatttttcctgcccgtcgagaaaggtcacggctccgcatttgccgcatacttatggggccatgcagatattccatacaaaataattatttttcaattgataagtcagcattttaccgtgcttttttcaaaagttcttccgctgtaataccaaacaatttcttagttgctccacccacccgacacggacaatctctgctctacaccttgtgcttccaatataaatgaaaccgatatggtgaactgattaaaatgcttctgttttttataactgatgattgaagaaatataaacaaaagcaagggggttgagagtaacctcgaatctgaaaaccttatctttacaagtttgaggtttcgaatgattattaagataaaaagatgtaaataacataatattagcagttgactttaacattattaaatgataatatcaacaatattaaagaaaggggttggtaatgagacgaaaagcgcaagaatggatatacaatttaagtgatgaagatatcacatttataaaaaattttgttatgtcatctggctctttaaaagaggttgcaaaattgtatcatataacatatcctaccgtgcgattgagacttgatcgacttatacaaaaaatgcaaatgaatgatcaaatagaaaatgacgcttatatttcattaattaaaaaaatggtaatagatgatcaacttgattttgacacagcaaaaatattgataaaaaaatacagagagcaaaaaggagaataaatgaaattttctacaattttattcatcgtaataataatggcattaaccattatttgtgtacgttttttagaatcatatttaaataaaaaaagaagaacaactaccgtatcattaacaccaattatttttcttgttctttcaatcgtattaattatagtgtatctgaattttgaaccagaaagttttgaacgcgttgagaagcaggggttattgacactctcatatagtttcgtttccgaaaatcagatgtctataaaggataagatacataattgtatcattatctttatacttacaaatattcctgctgttatatcaatttataatcggataaaaagaaatagaacgattacgcgcaaaaagaaaataaatgaaatgaaattgcgggaattataatgttcatctctatatattatatatagttgtgatgccgttggatattatagtggaaagcactggacaaatgcaagtgcttctaatgcaagcgtagattctgactttgttatatatacatataaactttctggacaaagtaacaaaaccacatgtacttcctcctgtattaccttaaaatgttctggaaatcttgatacttatgttggagttggaaatgtaggaattgtaaagattacatcgcaaacttattcgagtaaaaccaatttctatgcttcaagttatttataataatgaaaaaaagatatatagtgatactcgttttgcttatactgatcttactctataatagatatggatctggtgtctaaaatcatttaagtgcacaggtagacagtatttcaattgagacagtatgaaaaacttatccagcgcgaacgattagaaattgttcgcagataataaaacaatttaatggtatccagcaaagatctttaaatcattgacaaaaaaattacgcaatggtattatgaaaatacaaaaagcaataccgtgtaggcggttttccaaagttagttttaaaaaataaccggtctttggtaggggcggttattttttatggttaaaaaagatcattacgatcagattgataatagcaacaatcagtatgcaaaactgaaaaagttcagaatatgtaaccatgctatcgccctcctttcaaccagagggcaccatagccctcgtaataagggcaaaccgcctaccgcactatgctttgatactgctttctgtatgtatttattttaccatttttcgatcaaaaagcaatcaaatgttcgatatattttcgcgcaaaaaaatagcatcctctaccgtccaaagtttaggatgctatttctttaacatgtttaaccttatcactgtatggggccatgcagatattccatacaaaataattagtgcctgctgagtaagcagacactaattataaactttattatctatttgttttttctttttcattacaacaataacaactcctgccgcaacaactaccgctgctgcaatcagaacaataacaatcgtcatggccgcaccatcctgttttacaagtacaagtgcactgataccatccattgtatactcgccacccttgattgtctcgattgtctcaacgccagctttctgtccgtttatgcagactttccattttccttccggaattgtaacttttgcgttgtcagtgtttgcattaaaaagaagatacatctcttttgcactttcatctttctgaccgccctttatattaattcctacaatattatccccaagtccttctacggattttacatattttttcacatcctctgatgtagataaccgaagtgccggatgtgcctttctgaacttaataagtcccttatagtattcaaatacatctgcccagtagcatacggaatccacaatatatttccgtaccatgtttctctcggatgctgtatcatttccacatcctgagccgtttgaatacgaaccgtcttcattgatacgtgaaaaatatcccggaacaagtttattgatacagaaatcatctgcactcataacatgattgtataccacattaccataacacggttatttattgtcttgaaatctggagcatccctgcctataaccataaatcgagtaggaggcggtgactaaccgccgtcctctcacagcaccgtacgtaccgttcggtatacggcgctttcaatagttgacgtgcacagactgataggctgtggctaaatcataaaagccactgtttatcagtctttcttttgtcattgccatgtttactgcaactgtatgcgttgcgaaccaatgtccccgtcgggtattacccgcttgcattgccaagtcttttggtactcccatattgataagattacgtaccttcgtcctcggtttcttccactgtttccatatacacatacgtattctgtgatagagccatccgttgatgtcatctatgttcttcttcatacttgcaattccgtagtagttaagccatcccctcgcatacaccttgattttctcaaggcttggcttgattgactgacatcgcttacgggaagacagttccttcagtctggacttgaacttcttccatgacttcggatgaactcggacataaatgccctttccgttccttcccaatgcaaagccaaggaatttaaaattttggattgcaaacacactgacagtacgactcttttctcggttgactgtaagtttcagcctcttctcaagatattttgtactgctttccaagagtctctctgatgctcgcctgctctttgcaagaagcacgatgtcatctgcatatcttatgcatggaacacctcttttcaagaattcttggtcgaactcattgaggtagacatttgccagcaatggtgatagatttccaccttgtggtgagccttcctctgtatcaatgactactccgttttccattacaccgcttttcagatagcgctttatcagctgtactacacgctcatccttaacattcttgcgaagaaggtcaatgaggatttcgtgattaatagtatcgaagtactttgacaaatcaaggactacagcaaatgtatagccttgttcggcatactccttaaccttaagtattgcatcttttgcacttctgttcggacgatagccatagctaccctctacaaacagcggttcatagattggcactaactgttgggttattgcctgttggagtgtacggtctaccactgttggtatgccaagctttcgcacaccaccatctggtttgggaatctcaactcgtcttactggagacggagtatactttccacgataaatgcggtcggttatctcttgttgatgttcctttagataaggaagagcctcctcaatggtcatgccatcaattcccggcgctcccttgtttgccttaactctcttatacgctctgttaaagttgtctttatacagtatcgcttccaaaagtctcggctgtgcactgtccctttctttccatatccgattgaatgacctagacgctttcacatacccttcatgttctgcattatctctttgcgaacagccattgttttcaatgttttctgccatagacggtcattcctcctttctcggtcatactcaagactcctactgattcggtccttcacctctcggctactatgacctctgctgacttctgtgcgttcagcattgctttatgcaatggttacctctttcaaggcgtaccgcacagacctccctaggtaccacacgtttcttcctctccatccatctgtctcatttatcatgcatgattccgtgtagctattgggcttcaatttgatatgcaaccttaccctcatgcataaccttatatgagatttctgtccgtcagaccagagatttgcccatgagttagtatgttcctcacatccagcttccttcagattccatctcacgatggacacccttgctttcggctatatccttcccactaccgggcggattcgggactttaacccgttagaaacgtgcgccgctaggcacacatataaaaacgagcagcaaaaccggatttacaccagtctgctactcgtttgatgattataatattttcttttcttgtgccattgcaaccagttatcggacaaatggcaggaacgtaatgctatactttattttccaaactggctgatttctttcgcatatgatatttccgtttttcctcatacattttctcatccatatgcattaaaaaagtttctgcgtcatcttctgtcccaaattccgtgtatcccatggaaacacttaaacgaaacggttctatcccggattcattaaaccgggacagattatggttaatctcctccattgtcgctaagacacgctccgtatcaacacctgacagcagcacaataaactcatctcccgcataccggattgccataccagcatccggtatggatctgatgagtatatttcccaacgtacaaatagccttatcacccatactatgacctaaattgtcattaatacacttgaaatcgtttacatccatcatgattccatataaggatttctggcttgcaattttcttttccgcaagcaccgcattaaaatatctccggttgtataatccggaaagctcatccatatacaaactctctgcgtatgactgcatctgcacaaatatcaatgcgaccgcaaccagcacccatgatgatgtaattccataaaaaaggaactggataactacacctgcaaaacaaggaccaacgaaatagatcaccgggaaaaaattcaggttaaccccttgttttttggaatgatacaccagatagatactgtaacgatgattttttatgtttcatcacttttcacagcctactgcaactgtgaaaaacccacggcttacaaagttaacggtctttgtatcggaatcataataagatcccggtatcttaactgctgcaccgtatttatcaattttatatgcaaaaatctttttgtctttttcctttttcgaagcattataggaaacagcgaccctgatccgtccctttttcaggacagacgactgctttttctttattcctgtgacggaaaaatcataaaccggacgttttccaataattttccccgccctggcagaaagatttttcttgtcagcctgtttcattttgataaccacagctgtattcatctctttctttaattcttttaatgccttcgaatcaaaggtaagatttacattgccaccattgaccttcaattcttttacattctttttgacaagtaaatttaccgtctgcccgtccatttcaagatgcagattcttccagtttccggcttttgccgtatcaaaagttatttcaacagacagatcttttatcctgccaccctgttctttttctgcctttgtaatttcttttttcaaaactgctgcaatattcttcactttgacagtattatttttaactgcagattttactttgacattaagattcttaacagaaacgggcgtgtcttctgcggatggcggtgtcacattccctggttcttcttttgcatgatccggtgccggtaatgtgccggaatccggtgaaacattgcctgatgatccgtccgtgcttccaccggcattttctccggaacctccgccggaactcccacccgaacttccgccagaacctccacttgaaccgcctccggatattccgccggaaccgccacttgaactgcctccggaacttccaccagaaccgcccccggtctgggaatgatccgccgttacacggaccttgcaatctgccttacttcctgtatagttgccattcccattataacatgcggtgaacgtatatgttttcgtttcattcggaagcgttgccatccagtgatccgttcccttttcttctaatgtgatcccggaaacatcacaggttacttttatcccggcatcttccggaatcccctgtctgcaaagctgtaattctactgtccccgcacctttgaccgtatcggtttttgcagtcagctgcatactggtggaagccttttcgatttccaggacagcctccccgtatgttggaataaaagatgccttttccgctttaaaataaatcttatactggcctgcttctgtgtaaaatggcatctccgtttgtgtatacgatccgttttttgtcaaactgtaactgatttgtacaccatcttcctgtttgatatcaaatgtatggggttttccatcataagttacgcggacaggtacggtttgtatttccggcatctcactgtttttccggtaataataagtgatctcctgacgatcctctgtgatgtttatttctccctgatttgcactgtttcctgcacatgtatatccatataaatccggacttcttaacgtatacgcagaattctttggtacatatactgtcgcaggtgccgtatcaggcactgttgtttcggttccgtcttcgttttgcagcatataacgaatcgttacggtgctccacgcctgtcctgccgtctgattgtcagccagaattttcccggtatcctcatctatgatctttccttccagtctgtccccggaaaccagaccagttaccgcaggaagtgtgacagaaagggactctctggcagcatccggatcataccagttactgtgtggcggaacggtatatgtttcttctttttcatatttgactgtattgtctgctccaataatacggaaagtaatcttcaaatgctgtttggcatccactatattttgtacgactgtacggaattccagatcctttccatttgcttttgtgatatttgtctcatcaatccggtattggtcactatccctgtcaagtgttcccgtcctggtatgtggaattgtaatttcaggatcgcacacataaacagattcctgcctgctgacataatcacggttatttaatctccgcgccagttccattttgcacacttcacagaacggattcccaagatcccgcatcatgcagacgcggctcggtgcaaataccgtttctgttcctgctgccgttattccgattccacggaatcccagcatcttatgccatttaatcttatccggatccgatgtgtcggaaatattttctccctgcatctttttatcatattcatcgcctaatcttccgatgctgtgggaaatttcatgggtcatgacatccccctgctcattctcatccgaatttgccgaaaaagaaaagagtgcattggaagaagaaccaatattcgcagtcgtattacaaatgatatggatggttccaacggctgcgccggtatccagatatctgctctccagctctgccctcagtgccctggctttatcttccccgtcctttgcaaaatagcaggattttccgaatgcctgcacatgaaaatatgtgtccgggttcgactccccatacatcacgcccacaccagtttcattggacaccgtctgtactgcataaatattgatcctgtcggaatactctttataaggggaccactttagcagcccctgtgcttttgccgttgcatccttcaaaaattgttcctgttgttcctgggtatagccctcacccatgataacaatcacgaaattttccttatcatcacctgtcttgtgaatggcataaacggaagctgccgccatctggtctgccgccgtctggtctgccatcacaggatatggaaacaccagggaaagcaataatatcaggctaagtacgattgccccaaaccgttttccatccttcttttttacattcgtcatatcatcctccgtactttacattaccagaaataccggtgctttccctcttcttcccacagacaaactcccgggaaaccatctgccgtaaggcttcttaaagcacgattaccgcagcatcaaacccctctacatttccatcaaaggtgttttcggtaagcagattgtacttctgcgtgtactcattaaatttttttgcactgctgctgcagttaaaaatcatggcaatggtctcttcgccattttttctgatcaggacaattgtcccttcctcatcttctgtgacgctcccagccagttcgccttctacaatacatgcatggcttttccggacctgaatcagccgcttgtaccattcatacatctctttgtcctggtattcttcatcccagtacatgccccgtctgcagtccggatcgttggctcccggcatcgcatactcatctccataataaatcatcggcattcccggcagtaacaactgaaaagcggctgccagatgctgctttttcttattgtcgttacacagatgtaaaaatcttgcggtatcatggctgtcaatcagattccacataaggggatagcagtttttgtgtaagcgtcccttcaaatatccaagattttgtacgaactggctgaccgtaatcttttcgtctgcaagcagatcgatcaggttcaggtaaaatggataattcatgactgtatcccattcatccccctcaaggaaatctcctgcataatgccagatttccccaatgatcagcatatctttcttcacagcctttactgcctttctgaaattcttccagaagaaatggctgatttcgtctcctacatccagtctccatccgtcaatatcacattccttaatccagtagcatgcaacatccgtaatgtatttttcaacttcaggatttttcaggtttaactttggcattccgccataataaccaaaacatttgaagtttgggatctctccccattcgcttttaagcgggaatccatcaataaaataccagtcccggtatttggatttttcaccattttccagaatatccgcaaacgcaaaaaattctcttcccgtatgattgtataccgcatccaggactaccttcataccacgctcatgcgctttttgtaccagctctttgagatcctctgttgttccaaaggacgggtctatctggtagtaatccgtggtatcatacttatggcacgaatttgattgaaagataggtgtcatatacagcacatcgattcccagattctgaatatcatccatatgttcgatgattcccctgagatttccatgcagatcatccataggcgtaatcggtgctttataccacagttctttgtctaccggctccgttgctgcaaaacgggatgggaaaatctgatacacgaccttgtttgctgcccactccggcacctcaaacatctcttcctcccggaggttctgcggacagtcaaacattctatccctgtttgtaatgcattccttatcaaactcataatttccataatataccttttctccctgtgtgtccgtaaattcgaaaaagtaacgcagacagatcaaatgcatctttatctgtgcttcataataatcatgaaactgtgagacagcaaccttcttcatcggaactgtctttctggtatccttacgctccataggtatatacttgtcctcatagtgaaggattacctccttcatatcatccttttttacctgcacgcgtatcacgaataaatccttatcaaccgcatagctaaaccttttatccatatcatgaaaaattgctgaatattccataaaatttcccctttacacttgttgttttcctgtattttaacttacttttttcaacaattctagcactatatccacgatatttttaactttttctacttttatgcttttttgcgatgatattactgttcatataatttaaaatgtgcgttatcagtttaaaaccaataacgcacatttcctcattgcatccttttcccgcatttatatatgtcacaagtcaaattatagttcctacctgcgacaactttatatgtaaattcaacatcaataattttttgcaccgtttttaatttttattttctgcaactttaaatttccggatcatttcacgcagattttctgcttcactgctcatctcctgaccggctgctgcacattcttcagatgttgccgaattcgtctgtacgacatcattgatctgttcaattccatcattaatctgttggatttctgttgtctgtgtctctaacgtatctgcaatatttgtgacttcttttgtaatgatctgggaattctcagcgacctcctgcaattgtgatgccgtctgccctgcaatcaccatacctttttccacggctttcacagaggtttcaatcaatgttgcggattcctttgctgcctgggcactctggtctgccagcacattgacctgattcgctaccactgcaaatccctttcctgcctcccctgctcttgcagcctcaatggaagcattcaatgcaagcagattcgtctgggacgcaatttcattgattgttgcaatgatcttgtcaatctcttttgatgccccattgatctcattcatggaatcaaccatatccctcattttaccattgctttccagaatggcatttccaagttcgtctactcttccactgatttcttttgcggattgtgaattttttcctacctgttcagaaacacctgcgactgttgcggtcagttcttctacaactgctgcctgatttgttgctccatccgcaaggtcattggaacttgatgctacctgatctgcggcacccgaaacttcatctgaaacatgttggattccctttattgtctctgccatgctttcttcaaacaacataaaggagtttagaattccaacgaaatcccctttccactctacttccggctgcacatcaaaatttccttctgcaaacatcttcattgaacgtccaatatcatctacatagcttcccagaatgcggatggatttgcgcatattgtgtgccagtattccaatctcatcatctgaatggtagtccagcgtgctgtgcaggtttccatctgttaattcctgtgcaacggcttccacttcacgtaatggtactaaaattgactcaagtacttttttgcctgtttttattgccagtttccatgccaaaaccagacaaataataatacacacaattcctgccactgcagaaataaccgtaattctgactgcctggctgcttacctcatcggtcatttcatctaatcttgttgcaatttttacggctttatttaatgccggggtacaatcattcagaattgaatcaactgccttatccttgtcaccgcttttgatttctttcatgatggaataaccaatgtttccccagtctgtaagggcagatgcgtattcttcacaatccgcatccggaataactccggagttctttaaatttttcagttgggtattaacttctgcaagcagtctttctaccgtctgctcataaccgtcataagaggatgtatcattatttaatgccatttccctgatatttctcgctgatgagttaacatttatcctgcagattttcaccgcccggtctgcaacagtaacattttgtacataatgcatcgtattggcaaatagcatacctataaccacaatagaaaacagacctgagactagcatcataataatgacttttctgtagccatagtttatcctttccttcagatgtaaattttccaagttctttttcatcatatttttctttgacggcatagtttgctatttcctttctcttttattcgcttctgatatatcaaatttttttctcaaagtcaataaatttcaggaacaattttattattctatttttcacataaaatattgtacccattccccgaaaaatacagcacttttaccaattttttctacagttacctctccgatcgaacgtgatgtaatctggaatgtcgtgccggtggttccttcgtaagagtcatactagtacataactgaaaatactattgtctgaaacaccctctgttttcatatatggcatcaggttcttccaaaacattctctaattgtctttgaaatatctgaatcaataaaacctttatgtgccatgtcatcaaggatatcacatgttttttcatgggacaatccctttttataaggtctgtcttccgtaagagcctgataaatatcaacacatgccatcatacgttcctgctcatttaattcatcagcggtttttccaaaaggatacccttttccatttaatttttcatgatggaaagccgcccaatctcgtatttcttcaaaatcattaacctccgataatataaggtatgtataaccagcatgatttttcattgtagaaaattcatcatccgtaagcttatccggtttttccagaatttcattgcctaccgccatttttcctatatcatgcagtgcaccagccaaatacattttctgtaccgtgattgaatcatatcccatatatttggcaagcagggaggctttttcagctactcctatagaatgcctgcttgtaaaagaagatttataatctacaatctttgcaaagaaatccgcaacatttttacacatttcccaatcaaaaaccattttttctcttggaataatttcccatagcttcgtttcaaaagaatcatcacttaaacacataaaggattcttttgtgaatacatgaagaaaagcattaacacattctgaatcaaatagactatcctttttttgggaaagatactgacatataaaatcccatctattatcatcagatttaatactatttcctatgatatcaacggtatctgcaagatgaataattcttgcaggcaatggggtttcattccactttttttgaaaaggaccagttccatcggcatgttcatgatgatacaaaatcacatttgagacatctgttttaaaaggaagtttagtaatatttttttcaccataaatacaatgaagattcgtttttcttacggacaaatcttttttaatgtcaataacataattcctttccagctcttccgtaatatattgtgtcaaagcattatcatgcagtaaggcacacatagctaaatcttgtaacgcatcaccttgaattgccagatattcagccatgcatacacttatataagccactcttttcccatgcttgtttttgatttttaccaactctgcttctatacagtccaaagcataggaacaggctcctgcaagtccgacaatatctattcttagttcttctttcattggtataatcctatcataatacatttatgcttctgagaactggtcttttcctacaaagcataacggacattcaaaatcttctggaatatcctcccactttgtaccaggtgcaataccaccttctggatagcccttctcctcatcgtattcccatccgcaaacatcacatacgtatttcattcgttgttcctccttgtaaatatattaatacacagcctatattactgttatatttgtgttgttctttaaccttaatatgtataaatgcttttagcatttccataatccatgcaggttacaatatgcatatacttcttcctcagctgttttagcaaagccatcatacatatctgtccactcataattttcgccttctgccgctgccgccaggttttcctttgtatcaccaattcctgctaattccttgaaccacatctttgcaggttctttctcattatctgcagtctttaaaaacaatgctgacatctgctcgtagccttccttctatgctacagatgcaaaatatgtatatttatttcttgcctgggattctccggcaaatgcctcctgtaaatttttctctgtctgtgttcctgcgtatttgttatctgccatttattttacctccgttttctttacaactttttcaaaatctgatgctgggtgcttacataaaggacatataaaatcatccggcagttcttctcccacatattcgtatccacagattctgcaacgccatattgtctgaccatcctctgctttgccaacatcctccggcttaggcttaatgttattctggtaataatcatatgtagctgaaggaatattacttattacttccatatcggttatctccccgataaacattgtatgtgaacctaaatcttcagttttattaactgttacagaaatgtatgcatttgttccttctgtaatataataaataccattcgtgcccctggcacactgctcaaatgcttcaaacttattggtatctcttcctgattggaagccaaaatgtttgaacaattcaaattgtgccttctgacttaagactgatacagtaaattttccggttctttgaatcatatcatgcgtataatttgccttatttacacagatacttaactggtttggttccgaagctgcctgtatagctgtattaataatacatccattgtctttttcgtcttcccttgcagtcagtataaacaatccataactcagcttatacattgctttcctatccatattttcgtccctttatcttctccatgtattttaaatggtattctctaaatagccatttattcttattaattaggattaattaaccataattattatatagtattatagtattttagtcaatgtaaaacagtaatcattcctattttaaaaatttaatattatcctttattttcaaagaaatgcaaaaaatcaggtttaaataagtaccttttgttaccagtttatttccagcttgttcgcagaatgaaattgtaatatatttatccttcggtgtaagatacttttctatacatttagaatattcctttgatgcaagattaattataattctgctttcatcaattactgaacgatacagcatatcatgccagtactcatacagattttttgcatctcctatttcgacctttgcctgcatttccagatagtcttcagttcttctttggacttacaattcagccaactttgtatctctaatgttttatcaataaattctggcaatccatccggtgctatgctgtcagtatctgtaatcatctttttagcaggggataatattatcttcattaatctaattccttaagcatattctcagggtcatttgctgctttgactttatcattggctttaatgataactccctgttcattgataagatacgttgttcttaccacacccatagagacttttccatagtttttcttttctttccatacatcatatgcttcaatgactttgcgctccggatctgctaaaagagtaaatgccagtccgtatttttcctcaaatttcttgtgagaagctatagaatccttgctaaccccaagaataactgctcctttttctgtaaattgaggatatctctctgaaaagccacatgcctgcttagtgcatccggctgtattatcttttggataaaaatataaaattacttttttacctgcataatcacttaacttatgcatttcttcattctgatccggtaattcaaaatccggtgcctttgttcccacctctaacatcaattattcctccacttccgtaaaatcagtatgttttattgtctttttatttccagcaattagtttatgaccggaatatatagccataatcatgcatatcagagagccaaacgcaaagtatttgtgtgcttctcttaaccctttatatccggtataaaaagttccgattatggaaactaaagctccaagtgaccagtatttatgcgccttcattatatacctccatattttcttgttaacatcataatacacctgctaattatttttttaatactattatttctcattaacttatgcttttttgtacaaaacagtgcatgcttcttcttaagagctttatatattatccaattctcattaatatatcttctgagagatagtaacacttatggctgtagaagcttctttaccagtacacttttaatttgacgtgaaattcgtatataaatagaatgctgtaaatatgaaaaaacagttcataaaagtgttattttacgaactgtttgtatttttgtcaattttgaaaacataaatttagctgttaaaaacttgcaaaatattttctaataaatcaccaaatgagtaataagcctgtacagatatgggcattatttttacatgaatttgtatgataaatatatgtatatgatatccatagcatatacatatattgaaaaatatcatttccaactattcctgttaaataggcttcttgttcatttgtaattttattagcattgacatagtattttccagtgttatctatcataggaacattcgccactttgtctgaatcatgatggaaagctttccctgttttattttagtatcggtctggattctctctcataaagataaattctgctacagagcggtcatatgttttaatgtgtccaaatagccaatcgattacatttttctgtacaagttcactaaactgttctgttggtccttcataatcctgaaggtattcttgcagttcctgaattgtctttttaaactcttcatgtttttcgtgatgtttttcatactctggataaccagcattttcctgaagcttttcctcttctttgaaatgaaagttagtatactcatccagataatccagcattttgattgcttttagcttgctgtcgccattttgacatgcagttacaaaattctggatacgttcaatcaattctttatgctgtgtatcaattgttttatttcctgttattaaattgtcatcaaaagtaatatttaaatcataagtcataatctggtctccatttcttttttattttctcttggattctttttgtgtctgtcagtttcacatctaaattttctgcttactcttctaaaggaacaaaaacatcttttccaaatccatagattgggcatacccaatgctctggaatatcctcaaatgtaattttgggagcgatatctatgtttagattgcctactgctggttcataaatatagccacattgttcacattcatattttttcttttcaatgttttttttcttagttttctatgcttgtattatacatgataattttttttttttcaataacagtaatagtcgttatttttattttgaattccagtaatatccgtataaaatataacgcaagggctgctgtggtccttcattttcttctttgccggttctgactttttcgcacctgcacacttttcttttatgcctttaaggactgattttttcttttccctgtcgcttgctttatgctcaagatgcttttccactgccggaagatagttttccatggtgcctgtctttccttccgtgatcgggttgatgtccagctttattcctgctattgtcatgccgtcttcatgaagcatatcaaagaagtcatcctccctgatgctgcctttatactccacagccacatctatatcagagtttttattttctattcccctgcttctggttcctgtcactgccacatagattatctctgcatcaagaccgttgtctcttatcttatccattacataatcatgcacctggctttctatatctgccggacccagaccgtctattctgtgaaatttttcattggttctttccttaaatcctgccactgcatcaggaacatccgcatccgttttcatcttctccgcttccggctctgccccggcaatttccgttttctttgctttaagctccgactggaccttttcccataccagcttcagatacacattctcattttccataagctcccattccagatctttgcactcctgcagtgtttcaagcttctctaagaatagctgtcttaacaattcgtcaaaataatacagttccacaatatcttcaaaccttgtcccatccttatattttttagtggttgggttcttaaagatatccttatatccaccaatcagtgaataataacttgtctgttttaaaatctcctttgcatatgcctcattatcaatcaacagatttttctgtttggaactgcaggctttggtggcagtgatatctattttcggaaaatcctgatcatccggcaaattttgatgtattgatccagaattttgactgtgcattgtctcgccctgatgccaatgacctggaaaaactgaaagaagccgttatggatccatccttctgataagaccataaaataaggcagccccacataactgagtctgccttactctctttatttaacattgatgccactggcatattgctgcagaaactgttcttttccacatggtcttccaaaataatatccctgcagataatcaaccttcatttccttcattttcagaagccattctttttcctcgataccttctgcgcatatcctgacgttaatacaatgtaccatggggatgatatttttatataattcataatccctgtcactgttcatcgccttggcagtaaaatccctatccattttcacgtaacttggattcatatcacgaatacaatgaagattcgaatatcctgttccaaaatcatcgatcacaaagggaatcccgttcttgtccagagttttacggaatttacagaacgaaggtgtcatatccataaatccgctttctgtcatttcaacacataagcattccggctgtaatgaatatttttgaattgcatccagaatatcccgctccacattgccttgcaggatctgaacataggatacatttacattcatccggaagtcaggaatatatttctgcatttcacagcacattgctgcagcttcgttcaaaatatatcctccggctggaatgatcaatccggtctcttccaataatgggataaactccatcggtgaaacaaactcccgcccttcttccgttatcatggaaaaacgcatcagtgcctctgctccaatgatctgttcggactgacagtccacgatcggctggtagtatacttcaaagccatcataatggttcacaatagcattacgaagtgttgctatgattcttccttttcgtaaaaagacctcatagtcatcctggtcaaaaatatagaatccatttttacccatgctttttgcctgtttcaaggcaaattcaaactttttgcggcattcttcggttccctcacaaaatgttgctgcatctataacaccaatagaaatagaaaatatagcttcataattttcggctactatgaaattacgaagtttatctgtaatcttttctttcagtgccacagcgtcttctgcggaggaagcttccagatccacgatcacatactgatccgctaccagatggtaaattctctgcttgtctgaaaggcattccttcatacagccggctacgcttctcaggatataattaccataatcagctcccctggagctattgatcgctccaaaatcatcaattcctacatgcataaaaaatcccttggtaatgggttctttttgtgcacgcaggtaagcaaggaattccggaccgccaagcagtcctgtgacattatcggctcttctcctgttgccggtctcattcagacacccgatcagatactctgcctttccctgctgatcaatgatcacgataccacggctgttaatccagaccggcataccttctttatcaagccacctgtaatgaagattatgtacattttctcttccttcgcatatatccgcaagatgctttgcaagcatcctgcggtcttcctcatatactaccttcataacttcatttgcagcatctgtcagaacatttttcgacatattaaaccgttccacagctgactgtgaaatctcaaaggtatcattctgcagatcaaatatatacaggtaatcatccatacaatctttaatgatctcaaataagatttctcctgtctgctctccaaacactttaaatatatcatcaatcacaacaagaaccttccttccgacagctccactctattcctgccattttctagaatagcttaaagatattcacacggtcatgcatcttggctgctccctctgccagattaatactgatcgcagtattctcttctgaggatgctgcattgccctgtaccacgccggacagctgttcaattccctggccgatctgctccaaggactctgcctgggagttggctttctccatggtgttctctgcaagctctgcaaaggactccatatctgtaatgatctgattgaatgcgtctgctgttgttcttgtaatcgtattgcccttttcgatttccactaaggtcttatcgatcagatctcttgtatttacagcagattttgcactgtctgctgccagcttgccgatctgatctgcaaccaccgcaaagccttttcctgcttctcctgctctggcagcttcaatggaagcattcagggataacaggttggtctgggaagcaatatcctcgatatctgtgataatattaccgatctccttggagatttctgtaatgtgctccatttccgtgagcagctcgttcatcttttctttttcttcgttcgctttgtttgcagaggcttttacacgtgccgatgcgttctgtgtttctttcgctgtatcttcagccatatccacaaccgtatcaatggtggcattcagttcctcgataactcctgcctgctctgttgcaccatccgccagggattttgatgcattttccacctcggatgaattcgatgatacctgttctgccagattgctgatctcggtcagggtactgttaaaccgtttcagaatatacagcagtgatgtcttcaattccgagaaatcgcctaggaaatctgtaatatcatcaccatttctggtcaggtcaccctgcgcgattgcctttacctccacagagatctcgctgacataatctgccagaatacccatggcttctttcagattcctgatggtatcgccaaactcatcctcagactcataggtaagcatttctacattagacagttcgcccttacgcaggctggcaactgctgcatctatctgttctaccggctcggtaatggaattggtaatgatccttccgatcattgtcgtcactacagcaatcgcaagacccgctgccacgatcacaataaatatgattacagtgcatacattagccatggtctttgcctgatctaattctacctggaacttgccacataatatagttaatttcttagaaaatgacttataggcttcatacacctctccggtcatcagtttcgatgcttccagctcttactatatatatacgacatgatttcgggcatgtcaagagcagacgtcaaaaacgtccttctcatcatgcatacagattcagtgttttgaaatttagattcttttttttctggatgtttctgtgatatacttatacgcggtcgtatcagaccggaaaggaaatattatgttacaaaaattatatgtttttttcaggaaagaaaccgttttgtcaattgcagtgatcctggcgcttctttctatgttctgggtcagaccggataaggcttattttacttatatcgatttcaggactctcgggctcctcttctgtttgatggcaattgtagctggtttgaaggctgttggtgtttttgatatacttgccaaaaaattgctgatgggaacatcgggaactgtgggtgtgatcaggctgttggtactcttatgtttcttcctgtcaatggtgatcaccaatgatgtggcattgattacttttgttcctcttgcactgatcattgtgcataaactgccaaaggaactgggcaattactggcttcttaaaatagtagccatgcagacaatcgctgctaatctcggaagcatgctcacaccaatcggaaatccgcagaacctttatctatatgccagagcagggatgtccgcggcagaattaataaccctgatgcttccctattccgccacagcacttatccttcttctgatatggatacaggtagccgctgccaaagcacctcacgtatgcggttccgaaaaagataaaactcttttgggattctctgacagaaaagaacttaacatggaatacctggccgcttacctgatcttatttacaatctgcctgctcactgttgcacgtatcattccataccagattcctcttgtattggttcttatatatatgctgctaagaaacagggaaaatataagcagggtggattactccctgcttgccacctttatcgcattatttatttttatcggcaaccttggaaggattccgcaattcagcagttttctggaaagaatcatggcaggaagggaaacacttactgctgttcttgccagtcagattatgagcaatgttcccgctgcgcttcttttatccggctttacagataattaccgggctttaattgtcggaaccaatattggaggtctcggcactctgattgcatccatggcaagcctgataagtttcaaatatattgcaaaagaaaacaggaatctgagagggaagtatttgggaatattcacagcctccaatattatattcatgatattcatgttaatattgtattttttcctagataaatattttccgtaagttctcctccactggcatacattcttccaagaccgcataaaattttatcagaacatgtataaaaatgacctgtaagtgacattgattcagaaccgtcttgagtacactgtcaaagtcgataacaacacatctgagaacctgcagtccgctgaatcccgtatccgtgatactgatatggcagatgagatgacaagattctcgaaagagagcatcttgcagcaggcagctacttccatgcttgctcaggcagaggatgaataaattcttctttttccctttgcaacccccccattttcctgtatgatagagatagattaacagtaaggaggcatacagttatgttgcagattaaaaatccggttttgccgggatttaatgcagatccatccattatccgtgtggatgatacatattacattgcgaactctacgtttgagtggtttccgggagttcgtctgcacgagtcaaaagatttagtacattggaatcttcttccatccgcattgtccacgacgacattgcttgatatgaaaggaaatccgtcatcgggaggtatctgggcgccggatctttcctatgcagatggaaaattctggctgatttatacggatgtaaaagtaaccgaaggaccgttcaaagatatgatcaattatctgacgacggcagaagatatccgcggaccatggtcggatccgatccgtgtcaatggtgtgggatttgacgcatcgttgttccatgatgatgacggacgcaaataccttgttcagcagacatgggatcatcgcgaataccaccatgcttttgacggtattacagtgacagaatttgacacagagacaatgaaattaaaaccggagacagcacgtacgatctacgccggaacggacgttaaactggttgagggaccacatttgtataagatcaacggatattattatctgtttgctgcacagggtggaaccgtttggacacatcaggaagtagtagctcgttcaaagacgttagatgcgttgagttttgagacagagcctggcgatccgtttattacaaactttgatacgccggaacttgagatccagaagcagggacatggtgctctcgtagagactcccggcggtgagtggtattatgcaagtttgtgtggaagaccgtggaaccacgaaaatgaaagttcgatcgacccacgcggctggtgtccgcttggccgtgagacggcaattcagaaagtatactgggatgaagaaggctggcctcgtatcgagggcggacatggcggaaaagtgcttgtggatgcgccgaaagatgcaatcttgacagaagcaccggcagatcattcgatgcatgatgaatttgacacaccaaaacttcatgatgagtggaataccctccgcgtaccatttaccgaggaaatgggtacgacaggggatggcaggctgacattggttggaaaaggatccctcagcaataagcatgagctttcgttggtggcaaaacgctggcaggcatttaactttgatgccgaagtgaaagtgaaatttgatccgttcaactatcagcagatggctggattgacaaatttttacaatgataagcactggtcattcgctttcgttacgtggaatgagaaaaatggccgcgtgatcgaagtggcagagtgcaatcgtggcggatatcgttcgttccttcgcgacgatgcgattccggtaccggatgatgttgaatttgtatggcttcgcacaaaagtaagaaagcagtcttacagctacgagtattcctttgacggaaagaactatacagagattccgggcacactggatgccgctgtattgtccgatgattacgtactccagtcatacggtggattcttcaccggagcatttgtcggcatggcatgcgtggactactccggatacgatcagacagcagaattccgcagttttgactataaagaactggattaatcaatagcaagagccttttttaaaccaggctcaatcagatggctggcgatgccgcagaggattccgggaaaaaggatgaaaagtccgggaaccaggaagacgatgaggcaggcgccggccattgtaaataataagatgaaagtttctttgatgtgacctgccatcaggcgcacggagagcagaagaactgccggaaatgaagcgcgcaggtgtgagatcacggcaaagatataattggcgagaacccagaggacgaggcagattaccatccataaaaagggcggtaaaagattgccgttttttccggtaaagacttgggaaagatctacagccatcgtggcaccgtagcagagaaacaggattgttggtgcaagagactggaaaaaattggatttgaatgccgaaaaatattcccggcagatgtatcactgttcagtgtttggatgagagtatcattaactaaataaaagtcattcatccaaaagcagttagtcgcttggctgattttctactttgtcactatcctcttctctagacagtatactatagaatttttctaattcatcaatgactatatttgtaattgtactatcgaaaaattttttctcattaatgccgtgttcattcaaaacgcagaacagctttgaattgaaatcatgctcctgtattttattcaaaaactcttcaatataaactgtcgaaagcctgttcttatcacaaagcttgtaaacaacaaatgccacactcatcttgaagcgaagtgtagcaatatgtttaatgttcaacatattttccgacagtaaagaaatataatgaaacgcaactgggtatctaatatacggaatacaaccgtattccacacacgaaactataacatctatctgtcatattttctcttataacttactatttacatattcaatgctttttctatattctatcatatatttcattcctgtgcttccaatcattttcagacaaagtgtactttcatgtctgataatgatgtccactctttttgctgacgttgcattcacatatattttgatcaggttcttttctgtcatctataatctcctcctgtttctcgtaaatcgctttcgtttactcttctttacaagaattattgtagataaacacggagtaaaaatcgttccccaaacaatagacaaaaagtatattctgaatagacttttttcaatgaatcaaaatatttataaacggaacactaattttaatcttaattgattatattgaaattttgtcccgaataatatataatattcaggacaaaaggaggttttctatggcaaatggttattcaaaacaaattcagctgcgaattcatgaatcacctgaaggaagcatttttgtaaattctgattttgctgatattgcagatacagaaactatcagacgtaatcttaatcgcctgacaaaagttggtattcttcgcagaattataaatggaatttatgaaaaaccaaaatacagtaaattactcgatgaatatgtagctgctgatcctgcttccgttgcacaggcattagcccgcagttatcattggaccatcgctccatgtggaaacactgcccttaatttacttggactttccactcaggtaacagctgtttggtcctatattagtgacggaccttataaaacctatgaatggaattctacaaaacttgaattcaaacaccgaaccaataaagaagttaccggtctgtcctatatgacaagtctgacaattcaggcattgaaaaccttagggaaaaataatgtaaccccggaagttatccagactctttcaacaaaactctctttctcagaaaaacaggcttgtctgaaagaagcaacggaatccaccgactgggtttatgatacaatacgacaaatatgcggaggcaatacactatgagaaaaattgcatgtctgccagatgatgaccggagagaactcttccgaaataccgctgataaaatgggcttaaatgatgctattgtagaaaaagacttctgggtatgctttaccctggattatttgtttcaccgctgtccttggaaggactccatcacctttaaaggtggaacaagcctttcaaaagcgtttaatctgatcagccgtttttcagaagacattgatttaatccttgactggcgcgtactgggctatggaaaactggaaccctgggaaaaacgatccaatacaaaacaggatgcatttaataaagaagctaataaccgggctgagatttttcttgcagaacagttctgtcctaccataaaaaaggaactgtcattagaactgaggtgtgacgctaatatttacatagatgagaatgacaaacagactgttattttcgcttatccaaatctgttcacaaatccttctaccctacaggtaatccgcctggaaatcggagcattagcagcctggacacctgctaagcttgcaagcattgaaccatatacagctgtatactacccaaaaatcttcgagcaaaaaaatactgaaattcttaccgtttcaccagagcgtaccttttgggaaaaggcaacaattcttcatcacgaagccaacagaccggaacatctggatatgccacaacgatattccagacattactatgatctctatagaatggctcagaccccagtaaaagatgttgctttttctcacataaaccttctgaaaacagtcgttgatttcaaaatgaaattttatccaagagcatgggctaaatatccggaagcaattcccggcaccttaaagctgattccaccggaataccgctttcctgccctcatcagtgattatgaagtcatgaaagatatgttatatggcgatattccaagcttcaatactattatggaatcggtttgccaattagagaaagaaatcaattccctttaaaaatcatctgaaactgcactggccattctatttattcgagtggtcggtttctatttcagttaatacctgtatttgttttaaagcaatttccttgagtgcttggatagatttagttctcggtgcccgttttgtctttctattctcttatcttctgttcagcgtcaacctctaaaacgcttcgcacttcttcaatcgcaaaacactgacagaatatgccggtgcctcgtatacgaactctgaggaagcgccatgcatattcacggtaatattcttcaccttctccggctcttcaaagctgttttcatcccccttttcaccgctaagaagtgttacggtatagtcgccctgtacctgacagtccagtgtaatggaaaccggatccacatctcctgcaaaattaaccgccttaataatgatttcgtccttggtgtcagttactaccgaaacaaaagcaggtccgtagggaatcgaaatttccttctgaagctcaccatcaacatacaggcgaatctgttttccatccgtttcatatccaaagcggtgatattctcccggttttactgaaatagcaaaatcctcagtcagcttgttgtcatgcatatagccaaactcttccagtgaacattgtcctccattaaacttccaaaggaacggacgcaccagagctgcatcccattctttttccactccggccgtaatcacgatctgctcctcataataggaacgaaccaccctggcactgaatatacccaactcgaagtaagcattttcctcaacaaaaatatcggtctcaaatcttccataagtctggtcttcttctccaaataccacaaagctcttggtctcatcagcccattccagaatactgtgaaattcctttttctgctcctcatccggaagctgaagcaggcagccatcctctgtatcctgcacatgtcccattaattcatgagtaatctttgcttcttctccattccaaatgggatttctgaagcgaagttccttattggattttaaagatgccattccggttctcggacgataaacacgtcctccctcatcttcggattgcaccacatattctccgcgattttgaccgaacattttccagacataataagaaggaattccaaggctctgatgattattgaaacgaatcagattaggataccacgctctgtaatttacattttcaaataatggagcataagaggccaatgttacgatatcctgatttttctcaatacccataaggaaagccgcttctcccaaagccgcatacaactgtcccatatagttgccttcgtttacagccacctctcctacaaagatttttggtcccttacgatcgtagtcatcataataatttacacgttctgcaaagaactctgttgtattgtaaaaatgttcatccacgcactcggcaggacaaccatttttctctacatgctcattggctatggttttaatctggggatacagttcctttaccttcttataaatcatgttgtatcgcttttcataatccggaccccagttttcattaccaatttccagataggtcattttaaagggttccggatgccccatagaagcacgaagccttccccatttgctttccttagagccgatagcatattcaatggcatccagtgtatcctgtaccatttcatcaagagcctctccttccagaaggacactctttcttccctgacaggtcattccgcagttacatacatacaggggctccatccccagatcctcgcaaagctgcagatattcatgaaagccaagtcctaatgtacttctgtaatgccatacaaacagcttacttggtctttcccatgccggacctaccgtatcccgaaatctcatcgctgtggacggtgtcgttccttccacaatacagcctcctggaaaacgcataaactttggactcattcccttaagcttttctacaagatctgttctgagtccatgccccatgtaggtattgtcaggcattagtgaaataaatcccagcagaatctctccgccttctttgcaggaaatagtaagctgtgcctcatgacaatcctcagctgctgtcagcttcatgtcatatcttgtatactcctgaccggaaaccaccagactgtttccagccagtacttttccctggtattcgatcgctacgtccagtcctatttcttcctttgcttttgcaaataaatacaaagagtaactttctccagcctttacggatataccgcagtaaccggtattagtcagagatccgtccttttcaaactgcatacgcagagctgcgtcccgatgttcattcagggtatccgtcagttccagttccatctttgcattgtgtgtataccatgccggtatttctgtctccggaatattgttgccctttacccagcggcataggccttctccgtagcaaaactcatccagccatccggatacggtttttacatggacgccatcctcctgctgtatataaccctccggtaaaacggaatcttcgaagcttctgtttcgaagcatttccggataaagtcctccgtctccggcacggttaatgtcttcaaaaaagattccgtataaatccctggctgtctcaaatcgtctttcctttgttttaatctttaacttgctcattgtagtctccttttttacattccaagagttttgatcactgcctgtatatgcaataacatagattatgataactcaaatgatcttaatgcagcatttccgttaccgcgataggtcaggtaaagcgcctgtattccatccggaatcgtaaccggtgcggtatacttttcccagacattggtatattgaacctctaatgtcgccagtacctctccatcccatgctgtctttacttcaaaagtgccatctgcatagccccggatccaaatactgatttcacgaatatcatggcagtcaaaatatttgaagccgatggtagttgaatctgtaatattggcaatatatccaacttcttcgtctccatccctgccgtcctgcattactcgtggaaaattcccttcgcccacataaactgatggggtatcggtaaacagattacatgcaagataagcggggtattcgcctttaccctcaagcggacctccatttaaaccgcaggaggtaatttttacctgtggaatactgccgtccggcataatctgcagtttttcagcacatccctgtctgctgtaccaggtattattggtatgcctgtgataaaaaatgtaccagtcctctccgatctgcacaatacttccgtgattattggcaccgtaagctgttggcatatctgccggcttgtaggtatcgatgtgcagatcacaattgctgacaataactccgccatagacaaagtccttagtaggattcttgctggtggcataacataattcgtgcattaatatggatgaatagacaaaataataggtgtcacctactttacggatggaaggtgcctcaaaaaactcatgtccctcaaatccggtaccggcaccatattcacagccgggggccacaaacaccggagcttccctgatcgtcagcatatctgctcccaacaccgtaaccatagctccggtacgggatttatcaccttttccgcaaaatccggtataaagatatgtcacatctccttccgtcagaacccccgggtcaaactggggctcatcaccttccttttcgcccagacgtgtgccatcttcataatgaacatagccataaaattcatactttcctgccggagtatcacatacagcaactgaaactaccgaaaccttgtccaacacgtaataaagatagtaccttccgtccggtcccaccgtaacatccggggcatacagacacattttgccttccgggttcagcggatcggctgtcttcggataaatcacaccctcatatctccagttgcccaggtcatcgaccggagctgaccagcacacatagtctcccatgcagaaaacatatccgttaaagtaatcatgggatccgtaaacatatacgcgatcgccaaaaacataaggttctccgtccggaatatactcccaggacggtaaatatgggttaaacgcttgttttttcactttgatatcctcctttgcaagcctaatccatgtacattgtttcataaagcaaattaccgggtgctggtttaagccttcaagcttaccacacgatcatagtcatatcctcgatcctgattcacctttccggcattcagttcgaaataaaccacaccgttttcgtttacaggaagctctacgcagatatttccgtcctcctgctttttacgctctgtttttacaaaaggtctggatgattcccgaatcagcttcgtctgttcctcactcagattggcaggttctcccatatcatgccataccttcaagggattacatgtttcctcatctaccgtcttagtcaggaagcagtactcctcctgttcagccggaaatgtaaactccaacagcattttttctttaccctgttctgtacttttacgggcaatattccagactacacctagataatcaccgtttgcacgtttcaaaacgacaatattgtcatccttatatacacaattggcttcactttcctcaagctttttgtaaaaagcaaatgtccagaaggtcggcttggtaatacagccattggcaaccagtccaaagccgccgtggaatggtgtaaaaggaactccctgctcttcaaacacatcaccaaatgtccagtaggaataggattcattcacatctcccaatctggaaagctgctgtgctataagggccgcattcaggtttgtatcatgaatgacgccctgaggagtataggagctgttgaactccgtgatatgaatctgcagacccttatattccgggaaactgtcaataatatctctggttgtttttaaattggcaaagccgtcctctgccttcatcagttcagaatatgcataatgtccaatacattccggcggatcaatggtgtaatgatgtctggttacgaaatccacaggtatgtgattctcatggcaatattccataaatgcctgaatccatttctcatccgttcctccacaaacagcagggcctcctacacggaatcccggattcacttcctttatggcatcaaaggttctatggaacagcttaaaatattcctgcatatccgcattttcccagaagccgcaaagattgggctcgttccatacttcaatgggccattgaataacttcctcttctccatagcgtcccatcagatgccgcagcaatgaacgcaccatattacaccacatatcataatcttttggaggagtggtatttccctgccagtaaaagatagtctggcttccacttgccaactttttaggcataaaacccagttcaagaaaaggtctcagccccaccttcttataggcatccattactctatccagataagtatagttgtactcgacccttaccttaccatcctcctcataggtctgaaagatcgccatatcatcacagaataatccatgtccccggatatgcttaaatccgatttccttttgaaccaggcgcagctcctcctgatattcttctgtcaatgcaagccccattcttccggttcccacacaataatctacattattgtgaaaaaaggcctttgaatcctttctaatcacgatcttttttctgtcattctctgttgctccacccaaatttaccatgcatgtatctccttcttctaaatcatgttcctatgcagtcacgcatccgatgtctgaccgctgcacgatccgcagctctctgatgacgattgccatattaatctgatactatcgcattgatctaaagtttccaatgatttatactataagaaaattgatatatcctctgatgtatcagaacggagattccagatgactgaaattgaatttgtcggctacagtgccgttcacccctcagattttatatatgatgttccgaatggctttacaggctatcttctgcttcttttcgactctccctcggagctgctcatagacggaagactaatgcggacagccgccaattctgctattctgtatacaccaggaagcaggatttattaccgtgctgccggtgaagaataccggaatgactggattcgttttcgttccgatcactccttcgtgaagctgtttccgttaacaaacaccccatttcccgtaacagatccggaatactgtcatcagctttttaaattactaacctgggagtccgcctttttctcctctgaaagcgaagcaaacattactcacctgctgcgggttctgttctccaaattaagagaaggaatccagaatgagtccctgggtattcacgatcatgagctggttgcattgcataagatgatctacaataatcctcagcttccatggaatataaacatgatggctgcgaagcttcacttaagtcccagtcatcttcaggctctctatcaccgccaatttggctcctcctgcatggacaatgtcatcgaaggacgtctgcgccgtgcacaggatttattagagtacagcgaatactccatccgcgacatttccgagcaatgtggttataataatgtagagcatttctgcagacagttccgtcagcataacggctgtacccctggacaataccggaaaaatgcatcagcgggaagcaacaaaagacttctcacccacaataccctgggaggaagggagtttgagaagattaatcgaaatatccggaaatagtgtttcggtagctgctttattcatcccaatatttgttcatatttaatttcaacatttccaaaatttcacgcctcatctgctctgctgtgtaactgacagggaaaactctgtgaagctgctccgttttgaatactacgcggtctatctctttttgcttaatttcacttgcaaagtcaagtaaactatctataattacttttcattggcgatatcccagcaatatttctaaaactccaaactatccgcattgagcagaaaatacttcattcccatgattacaaagccttcctcatttctccaaggcttttttgttccgtttactaccacgatctttttaaatgaatcagggatatttctaaatgaattaaattcctgcttctgcttttcctcagaggtcatatcataagccacctgaatataatatctctgactcccctgattgaccacaaaatcaacttcaaactgctttcgagttgtttttccttcatcatttttcgcatacgcctctacaataccaacatccacattataacctctgataagcagctcattgtaaacaatattttccatgatatgagtaggttcctgctgtctaaaattcaatcttgcatttctaagtcccacatctgaaaaatagtatttcagatttgctcccacatattttctacctttaatatcatatctgtcagctttagaaatcaaaaatgcctccacaagataatctatatggttggatatggtcttattgctgtaattgatgcctcgttcacttttaaacgtatttgatattttagttgggttagtaggagctcctatcgcagaagcaaggatatctactaaagtatcaatctcatcaacatttcgcagcttgtttcgttctacaacatccttaatataaacatttgtgaaaatgttttttagatactcagccttttggcgttccacagaaaactgtagcacttgtggtaaaccaccatatatcatatattcctcccaagcatcatcataatctccatcgaaagccgcatagaactctgcgaaggacaacggatatattcttatctcatctcctctgcctctaaattcagttacaatatcgctggataaaaacttagagttgcttccagtcacatatacatcaatattgctgattcgaagcaggctattcagcacttcctcaaatcgtgacataaattgtacttcgtccaaaagcagataatatttctggtcatcttccacccgctctttaatatgctggtaacacttctttggatctctcagctcctcattttcaatgccatccaaagcaatctcaatgatatggtcattatctacaccactctccaataaatatttcttaaacaatacaaataacaggaatgatttcccacatctcctgattcccgtgataatctttatcatcccattatcttttcttatctttaactgttcaaggtatgcatctcttttaatctccatgagttcaactccttgtttttgtaaatttacacactttttggtaattaaattatatcatctaggatttatttaatcaatatacattactattttatgtgtattttaacatttctatgcagttgataaccaattaactatcttttcatagaaaagcaggtagtctttgatacaatgtcaagtgatgaattcaaaaaggaaaaaattggacttggaatggcgattgtaaacgggaatgaatgctcaccttgcaaagcctgtaaaaatcgaaaatgtaaagaaaattttgtgcgattattcggtatagcgattaggatttctcgaatccgtaaacccattttccacgtaagaacagatacagaaaaatcacggagctgataccccaagtcaatgggtatgcccagaaaatcactcgtatatccgggagaatacgaactgccacagtaatgtagcttacgcgaaacaaacaccagtcacagagcataacgatcatcggaacggatgcgttacctgatccacgaagtattgctgcgatgcaatgagaaaacgccagcagacaataaaataacgcaattgttctggactgcatgactccataatgtacaacatcaggatctctgttaaacgctgtgatcagtaccggtgctgccacatatatgataataccgatcaactctgcaatagtaatcgagcagagaactccaaatcttgctccctttttcgcccggtcatactgttttgcacccagattctgactgacaaaggttgtcagagccattgtaaaacaggtcaccggcaaaaaggcgaatccctctatcttggagtaggaaccacatcctgccatcgccatttttccaaatgcatttatatttgactgtacaaagacgttcgcgatcgcgatcactgaattctgaaaaccggatggtacaccattctggatgatctgcttcagcatagaactgtcaaaacgaatctctcgcaattccagacgatattcttcttccacacgcagcagatgaaccatacagagcagtgcactgacaaactgtgaaattgcggttgcaagtgctgctgatccgactcccatgccaagacctgcgataaagaaaatatccagaacgacattgacacaggaagaaataatcagatatatcagaggatggcgtccatcaccgaccgactgcagaactccaacaaagatattgtacatgacaacacccatagaccctgcaaaatatgtacggaaatacacaatagattccgggagcacgtccgcaggagttcccatcaataccaggatctttggtgccagaagcattcccaaaactgtcagcgcagcaccggccacaagtccaaatgcaaccgttgtatggattgccttttgcaggcagtctctttttttggctccgtaatatcgtgcaataacaacacctgcacccatggcaatgccgttaataaaacctaccatcagaaaaatcagatttccagatgaactgactgccgccagtgcattacttcctagaaaatttcctacgatcagggaatcagcagtattatacaattgctggaacagatttcccagaaacaatggaattgcaaaaaaaatgatcttttgggagatacttccctctgtcattctcagactctttttcatagttaaaattacgcttcactttcctgtgttctttgaatcaatagagatgaaggactgcttgtagagctggaatttggaacgtgctttataaattttttccgatcccctcaagttcgttcatggaatccttgtttttttcaagttcatctctagctgttgcgtaatatgattttttgaaaagcatatcccatgaaagatattttgccatacagtcaaactgcttatcaatcagctcatactggatactgtctactggagaaccgcctacaacaatcgtgccaacttttttattttttaactgcaatccacggcagtagcacttatcaatgataagtttcaattgtgctgacattccccaccaataaactggtgtagcaaaaagaatcatatctgcggaagcaattttatcaattgtaggatttgtatcatccttatcgacgcatcccttagagcattgacagacaccacatcccttgcatggtgcaatgttgagtttgtcaggttcaatgatttcaatttcattcttttctgatgctccttttataaatgcattgattgctgtcagcgtgtttccttttctggcacttccattaatgattacaattttcatgcgtgtatcctccaacttccggtttgtatgtctctattataccataatgataccatcatgaaaaataaaagtaggggctgtgaaataagctgatagaaaattttgaaaattattttcatccttaattttcatatctgctattatacgttcttccctctgcctctcttcacaataatcccaccacttaatttcagcttgtaggtgacgctggtatgacgcagactatgaaacactacatctggtaaccctagttcatttcctgcatttttgtccttagatagctgtctcctataggaagaccaaatcttgtcgccattaccagattataatcctgatattcatttccaagcacttcctttatctcatcctgatctgctttcagatcaatcagacattgtgctactgattttggaataaacaccttcctgacactgctgtctgtcttcggtgttttcagcactctgaccgtcctgttatttttcttctggcttggaaatatcataataatttcttttgaattgagtgcttctattgcatcctttgatactctctctaccaaatttattttaccatccgaaaaatctgcacaaaaaaactcaggtgcacaaacacacctgggttttctgtccttgcatagaatccattttcatattcctattatggcttctatttttcgttcatctcttccatcgaaatcacatcatcaagaatataacaaaaagtcggcgaggatgactgtgcattttctttatacggagaattcagatcgatcctgtcattcggatcaaacacactcacaccggtaaatggtccggaaaagacctccaattctcccttgcttaattttgcaatggtgtcctcaaccatttcctttgttccgcttggcgcaacggtctcattgagatccagaatccgtacccagcccttatcaagaccagccatagcatcctgtccatacgtccgtccatcgatgcagtcttcgattttcttatcatggagcagggctccgatcgactgctcaaaataatacgagtaatcaacacaacaactgatcagcgatttggttggagcaatgtccgtcatactctgattgtatccaacatgatagaccgggatcttcagttttgcattctcgcaagcggtaactggaccaatggtatccgaatgttgtgagataaccacacagttttcatcgatcagttcgtttgcagcctgtttttcaagtgaatagcttgaccatgtattggtatacttaacgatcatggtggcttccggaaccatcgattgtaccccaagataaaaagcggtataaccggatattacttccggcagcggaaaagccgccacatagccgacttttgcctgttggggagtgatgatatttttttcgatcatctgtttgattttcattcctgcaactctgccgcatacatatctgccctgatagatttccccaaaacaattatgataattcggcagaaccggatccgaatttgcgttatctcctgtagggacacagaactgaatatccggatactgttcagcgatggctttcacatccgcaccatacccataactggctgcgataatatagtcgcagccttcatcaaccagctcctgaaggtgcgattccacctgtccctctgccacattataaatggtcacacatgcaacccggtcaccatacacttctttcacatgatctctggctttaataaaattattggtataaggtgtaatttcatcccctacaaatatgaatccaaccttcagatgcttttcatcctctctggttattttatggattccaaaggaaaacaacgacatcaccagacaggttattatgcacaatgtatatactcttttcattctttctgctctccttttgcttttgcatataaccgttctgcatcgataacgccttcctcaatcaacgaaagcatgatttctacaaggtgcgggtcaaattgtgttccgctgcagcgttttaattctccaatcacaaaatcaagatccagttgttttcgatatacacggtttgcggtcatcgcatcaaacgcatctgctataccgataatacgtgcctctatcggaatttcttctcctttcagtccatgacaataaccggttccatcatatctctcatggtgatacaaggctccaactcccacattgtcaatcaaagtaaaatcctttaaaatttctcctccccggattacatgtgtcttcataatttcatattcttcatcggtcagccttgccggcttatttaaaatcgcatccggtattcctatcttaccaatgtcgtgcaacaaagccatcttgcggagattttcgcattgttcttccgagtatccgaggcgttttgcaatagcaaccgaatattccgatacacgataagaatgctggctcgtattggaatcctttgcatccacggtgcgtgcaatcgaaagaatcgtttcattgctcatctggatctgtttctttgcatattccagttccagcttctgcttcagcaaggttctctgcatcttcgatcttgtgataaaccaggtaatccacatgagaaccagtcccgcaatcaaacagacataaagtttaaaccaccagttctgatacatctcaatgtctttttcgatcacgtatctaccggcctctataacatttccgttcacatcatccaaaatcgctatttcaaatacatattgcccttgtttcagattcgtgtatgtgatggaattcaattcgcttaaccggcatacccgttccgacttatcgtagccttccagcttaacccttacatacggatcatccatggaataattcaacacttccggtgaaaatgtaatctgatgcgcatctgcggacaattgaaacggatccacacgattgatctccatgctcttgccgtcaacctttaccgaattcaaaatcattcgataggactttgttgtcatatcgtacttcgccatatttacttttactacgcccgtatcgcagcatagatacaaatcatcattttctcttccgatccatgaatttgcgactaaagaagcccgaaatccccgtttggaattgattaacggatattccgtcctcacattttttaccagatctttcgcatttgcaacgtaaattcccgcactgctcaaaatccagcaggttccgtcgctgttacatatcagatcataattattgctgtatggaaattgatcaagaatcgtcactttgccgtctgccgacagataacaaagcccattacttgtgacaataaaaacaccatcctgaatcggatcataaaccatacgaagaaccacatccgatgataagccattctttttcgtaatacttgaaacatggttatccttatcaattcgtgtaattccgcctccatccgatccaacgtagcaggcatcttgatactccaaaagacaaagcgatttctcattcgccagcccattttttgcatcaagaatatttgcaacggaatcctccgacaaaacggcaactccataatctccggcagccattattttaccatcactgcactcgatgatcgtccggaaccgcatgcccggcattccgttttcttctgtaaaactctttatatgatatccaccatggttttttgcggtaactttatatacacccttctccgtcgtagcaatccacaatgcatttgtactgtccactttcaagcaacggacacgcaccccctgaagcagttcggtaagggtattacttacttcttttttgtcgtcgattacaatcaacccgctatccgtaccgcaaaacaacaatccatcccacttcgccgtcgtattgacgacgacattctgcccaatcttaggaaataattcttcaaatggagattggcacatctccaataatcccagtctggaggaactgaaccacagattgccctggtaatccatcagcatattgtcaatggaactattaaaattattggtattgatactctgacatctgccccctttgtcaatcaatgccactcctgtatccgagcagacaaacaattctccgttttccgtctggtaaaagcaattgattgtttcgcatccgtccatcacaatcctggattccaggaccggcttcccagatttcattgtataaacatataccttattatccgttgttcccagatacaactgcccatcctgcgaaaaaaacgctgccttgtagcatgcatccggttcaatgccttccggtgcgggtatctgttttccattgttgatccagaatacatctcctcgctctgttaccccggccacatttccgttatcatccgcagtcatcgaaactacatttttaatttgatccaatgatccggtcaccttgactccgccgctgagggatacaacggacagcccctcgacggtaccgatataataatttcctaaagaatcacatactatctgtttcacagaattggaaagcagaccattttgatcatctactacattaataggctcctcattgataaaaatagtaacgccgctatcattcgttcctgcccacaatctgccctcttcatcaacatacaggcaatttaccgttttgaccgaagaaatgtcctgaagatacacaaactttgctccatcatatttgaacagtcccgcataggtagcgatccacagctttccatcctttgtctgtgcaatatcattggcttcgccggatataaggccttcctctttcgaatagatcttctgcacataagaatcatagtctattgttgtttcctgcgcattcgccgtatcaatgctgccaaagcatcccgaaaccgccagaatcaataacatgagttttgctgcagcctgaagcttctttttcgaacctcttcgcatacagcgcacacctttcagcagcaaatagacaatttccacactcacaagcttgtctaaaaattcaacgcaaaactgtccgatcacatacgaaacataacgagggactcctttatccatgcacatcatcataacctgatttccccagacgtttccggacattccattatacaaaagcgtattgatcaaaaccgcaacaatggtcgaaaaaacggcaagtcccattcccagagtcatggttgtaaactccctgtcaaacacgttctttttggaaaaataaccgacagcaatgccaagcaaagctccaacaatacaataaaccgtttgtcggtcaacaaagattccataaatgatattattcgaaaagccgaccacggcaccacacaccggtcctcccagatatgcaatcagaaatgtcccgatggaatcgcaccatagcggcaatacgaattgatccgccaaaacgcgtccgacaagatccaaaagtaatgctgcgattgtgagcaaaacaatccaatatcccttcttatttttcatttgtatcctctctcctcttccgcaaccagactgattacggctctccgtttcttacataagcaacaatcatccctttgattcgcttcaattcagaaacataattctcatcctcatctgcgccccagataaacccatttgcataatatgtgcacgctgccatcatgacgtgaaccgtctcacgcataaactcctcaaacggaatatccgttctgaatgtatggtcttctttggctttctcatacattttaagaaatcttgtatctgccgaatataaagataacttaaaattattgagcattgcactgtctgtacctgcgcggctgacaaaatggttaaaattatcattaaactgcaaaagtgctttatggttaacgcacatatcaatgtaactgtccattgtaaatataaagcgatcgatagcaggaatctcattgatggatgcaatcggtcgtttttcgtccaattcatctagatattccttccattttgctgcgttaaccgctatcaccagttccagtttgctcggataatggcggaacagtgtagcccttccgacgcctgcagcctgtgcaatttcactcattttggcagattcaatcttatctctcacaaatatgtgaaatgcggcatcaatgattttctttttgtctacttgtttcataacttccccttattgatacttgcagtcttaatgttagcacaaaacgtctaaagattcaatcattcatccgcaatctgttttcctgccacatccatatgataattctccctcatgataagttcggagatcggcacgatcgtataccccttctcttccaattgcgtcaacatggtgtctaacgcttctgccgtatactttgcaccattgtgacagagaatgatcgctcccggaccaagtgccttatgattacaaaccgtatcaataatagaatccacaccataatctttccaatcaagcgaatcaaccgaccattggatcggataatagttcatttgatacgccgtcttaatgactgcattatcatatgctccatacggtgggcggaacaaaaacatctcgtaccccgtcagtttcttaactctgtcatgtacactttttaattccgattctttctccgactgagaaatggttgtcatatcataatggtgctcgctatgattcccaagatcatgcccacgctttacaagctccttcacacaatctggatgatccgttacccagcctccggtcataaaaaaagtgactttgacattgtgtttatccagcgtgtccataattttcggaaaatcttccgcgccccaggcagcgtcaaaactaagtgccactttattctccgttgtatccacacaatagattggaagttccctgtccccaacagttgcattggtatattagagaggctaaaagtctttatttcaagacttttcagcctctttttggtataataaaggtatcaaaaaaggcggtattcttctatgatgacacaagaaacagatcttattcaatacctatatggaatcaaaagcatggtttacaaatccccgaagtctttccagctcaatctctacaactctttcatcctgatccagcaattccttcttttcttccataggcaacttcctttctctgaacgcaaaaaagcccgtccagaatagattgtatttatctaatctgaacggactcttccgacaggcctgatatcacagacaagaatatagtgttttgtttcactgcttttcctaattttacaccctaaaactcatcctacactgtagttaatccctctgggtgacggctaggaaagtgtgaattggtgacaagcatccatccccgctgacaaaatcagtatatttaaccctgtttcgctgacaaatttgtcactgaaattgcaattctgcatgaaaaaagcggcaatgaaactatcttcattaccgctaaaaatgagcgtctcctataggaatcgaacctacaatagagtcttaggagctcgagataccactaaaaacatatataattcttagtaaagttaagtcaaggaaatccttgattttcctaactattctgttactccctgtcaaaataagaaaacctgttttcatctctgtaaaacacctttcggtgctcgtccggtgctcggagcacccggaggatataaccattccgttccatcgagttcactcagttggccaccattacgattcagcttcgtaacaatgatcacttggttttcttattagattaactatattataacgtgctgtaggtcggatgtcgatgattttttgaccatatttattgttttatatgtttcttctctatcaattctgcaaatactaatttttagacatgacaataatttttcgtcaaaaactattttataagccatctttccccgttcggcataatacgaatatcccccggaaacctttccagaatcgtgccgtcatgcagagaacgcaccaccgtttcttcacgatagtctgggtcttcataccaaacattgaagtaaagtttgtctccatcacggaaattaagcgcttctctatcattgattgcgaatcgtacatgttctggccagataatctcgaatgtaccgtcatttggctgtcgagtcagcgataacggtgatgtatgaagcatcagattgtagcagtccttcactgcagataacggtagccgcgctacttcctgtacttccacttgttgatgcaagaacctcatgatgcggataacactctctgtaaagctcactaccagtagcacaacagaactgccatcatacactggtgtgccaagatattgtccgtctgcagaatgcacaggctcataaatcatgccgtctgggtaatggataagatacaaacggttgctccgcacaaggtgtccctgtcggaatagttcttctgcctcatagagatcgccgtgaatatagtccgttgcccagtaccattcggcgattcctccacgaataagttccatattggtcataccatgtatatcaatgttcttcatgaatacacctcccgttccacaaatatatattactacaatacttcgtaaaatttcgattttcttaattctacaagctggaatttctatttgtattgccatgtcattacataatctttttctccggtagcctcatctaagccactatgctgaatctcaaatccttctctcttataaaaagatattgcccgtgcgttcttttggtatacgttcaagtgcaacttattccttttatcctttgcataattcagcagaattttacctataccctgcgattgcatttcaccagaaacaaaaatgccctcaacatattcatcatttaaccctataaaaccctgtatttctgtatcatactcatacacataaacctctgctagtaacaacgcttcttttactgatctgaaattgcttttccagtattcggcggggataaaattatgtgcctttatatttgtatccaaccatatatctgcaactttatttatatcatccctttgaaattctctaaagaaagaatccgattggcaaaatccatgtttatgactgaaaacaagaaatatatcgatattgcttttgaatgtggatttaacagtgtttcttcctttaaccgctccttcaaaaaagtaaaaggtatttcaccgcgagaatttaaaaatgcaatgataaaatccttataaattcttttaatcacaaatataccctctttcattagactattattttgctaatgaaagcgggtacttcatttttaataatcaatataggactctaattttttcaaatctttatagtcattacttcgccaaaggtcctggaatagtagatactcctctgtgatttccataaaaatccacattaaagataatatccgattcgtctctttcctcaaaacgctgttccggctcaaaagctttacccaaaatgtcacttgttataataccattagaataatctccgagtatttcgtagatatttgtttccagctcatagaatccatctttttccacaagctctactgtaacttccgtatcggcatctacaaacttatctgtttcttttttccatgctttagcacccataaggtatgcattaccatttgcccagattggcagatgatcaaaatgcggcaccgccagcttatccatatccggtttctctacatccatatcaaatctagcaatccattcatcatatgtcgggtattcatcccacacatgattgcctacaacctgataatacggagattcctttgattcattattatcaaccggataatactgtacaaatatattgttatagaatctattatcaccatgaagaatggtcatcatcccagcaacttctgtcctatgtctgatgtgatatggtgtgtaacgacgctgacttcttccatccacttcccaatctgttccggctccaaccactgtggtggaaccaagaataagattatgtacaaccgccacaccttctgttgcaagacggagaccatatctagacaacaaaatattattatcaatcaaagtcggtccatgacctacttcgataaagatatcctggctttccataccgccttctaacttaatagaaccttccggaacatcattatcatgtaacagattttgtgtaattcgagctccctgcgcttcccagtcaagccaaatacccatggtgttatgatgaatatgatttcttctgatcaacacatcaattgccgcatgaagtttaattcctgagatttccgcaccccccagctccatcatattgttaatatgatgaatatgattatcttcgatagttgagaaaacacagcccattcttcctacaattccggtctgctgacaatcatgaatattgcatcttcttacagtatgagagccaatctcttccttcagccaaccatgatactgtccgcggcacacagcatctctctccatctgtgtaggactttttatatgctttcttgtaaaataatggtcattctcatcatcgtaatattttccaagagaaataccgcaacatttactgtttgtaatttcacagtcttcgattatccagccatatgaccagtgtgggcttatcataccatcctggaacgctgccggaggtgcccatgtagtagctgccttttctacaaagaagccacttaaggtaatgaaatcaacatgctctttctttggcataaaacattctcttcgcacattaatctctaccttttcttttcgcggatcttttcctctaaaattagcgtatataacggtttcatcaccttccacataggcataccatttataaacgctccactcttgttcccacgacggcttatatacttccgctttttcacaagcttctatagaatccacttcgtacattgccttgtcattcagataaacacagcctgtatgtttttcatccttggcaaaataccaatccccataaaccggtgttgtatatgggttataaccattaaacacgccattattgattctggtcacccacacatcacctttataaagtttccaagcgtcaacttcttccgcaccggaaataattgcttttaagggttccaccgacctataaacaataggcgcttcttttgttccactgtttacgggatttacatactctctgtaaatacccggctttactaagacttcatctcctgcaaccgcaatctttgccgcttcattaattcttttaaaaggcctaaattcggaaccgtctccatcacaccttgcagatgcatctacgtaaattttcatcttctacccccatagtattctgattatcccttgcaatagcactaattaatcgcatcagattatcatattttacattttgtatatttcaaaatctatccacatcttccaataaacaaaagcaaactgtgccaaaatacttttaatctgttcataatcttatgaccaacttttccaaaccgtcggttcatatcccactgtggcctgcttaccatttctgacaatcggcgtcttaattacctgctgatttgcaagaagtttttcttcgcattcatcctatgaaatatgttttaccactgccagcgcatctttacaagccttttgccgggagttccgatgaatctttgtattttcgtataataatcatataacttataaataataaaacagctgcgctggtccaggcacaaatttccgcataaaaaattccgtcttcaccgatcagttttggtaacaataatgcaacactgacacgcatcacaaattctgcaatgccactggcgaggggaatcagggtattacccagaccctgaatcgccgaacgatatacatacagcagatacagtacccatagaaaaattgccataataaacaaatatttatatgcaatgtctaacacctgtcggatctgttccggttcgccggatacaaacagtgacaatatattgcgtccgaataacaccatcacacctgagatcacaacagaagtaagcaatgccatataagttccgctatgcacacctttccggattctctgatatttctttgcaccaagattctggcctacataggttgtaattgcatatccgtatgaaacggcagccatctctaaaactccatataatttgtttgatgctgtaaatccagccacaaacaggaatccaaatccattgactacatactgtactgtaagcccccctacagagatgatcacattctggattgcaagaggagtcgccactttcaaaagccgcagactcattgccggctgtctatagaagtcctgtttttctagtcggatatccggaattttccgtaacaccatcagacagtacagggctgaaactccctgtgcgatgactgtcgccactgctgctccggctacaccccagccaaaaactgccacaaataacaggtccagtcccacattgatcaacgctgctacggtcattgctatcagtggagatctgctgttacccagtgctcgaagaatcgctgcaaatatattataagccgctatgatcggaattccggcaaagatcagccgaagatatagcattgtcaggtcaatgacattatccggtgtctgtaaaaacaaaagaacatgataaactgccccttcacttaccgcaagtacaatcacagaaagcagtgctgtcatgatatagcttttcgccaccgcgcatttcagattttctttttcccttgctccataaaactgagctaccagaatagaaaaaccctgtgtgatacctgtcatgataccgaacaccagccataccagccagtctccggcgcctactgccgccagtgcttcaacccctaccacctgtccgacgatcatggtatctgccatcgtataaaactgctgtaagatatttccaagcatcagtggtatggcaaaagtaatgatcagttttccaggtgatccagtggtcatttttttttcatttgttcccataaaaatctcctttttcttttcatccttgtccgattattttacataggactctgccaaaacgcaatccatcacagaactctttggtatatcgccccgggtttttacggataccacaggaagtgttcctccctggacacgtaccgtgctggtcacgatcctggttggatcggtcacctctttctttccataatctgctcctcttttacaggtatttcccgtaactttttccactatcccatcctttattataacctgaagctgacatcccatggggcagccaatacaggtcagttttctctcttccatggtctattcctcctctatactgatggtgattatatcctttttcccggcttttttcagcacttctttctcaaagggaaagttggcaaacttgaagttgtatcatcacttatcttttttagaagaaataggactgtcagatatagcaagaaatatacccagacatatacccactccaattccaacaaccttgctgtttaaaacaatactccaaagtattgctgttgatattcctatgtatgctgactcctttaattatactttcgcttttcataagctttgtcctccaaattagcacttcaaatcgttttctttattctatcacagcttctattattccgccatcagtctttcaaaccaagtatccatgtgaaaattgcaaagtttaattccgccatccatttatacagtggaattctcttctgcacaagtggagtttaatctttcatatcataaatggtatgctcatgttggccttctgacagcagtagaaggagaactagcatgagcaaatatattcccggtaatcaaaaacatcttactctcgaagatcgcaaatacattgaaaaatccctaaacgctggctattcttttaaggacattgcaagatatctttgtaaagatccaacaacaatctcaaaagaaatcaggctgcacaggctcagcgactggtatcacaaaggctgttttaacaatgcacataacttttgcgtccacagatatcattgcaaaaaagtcaatgcctgtggcaagatcattctctgcggtgtcaaatgtaccacctgtccaacctgcaaccagacatgtccagactttgtcaaagaacgatgtaaccgactcgataaagcaccttatgtgtgtaatggttgtccaaaagcaatcaatcactgcacgattgcccacaaataccgctatgatgctatttttgctgaccgcaaatacaaagaatgtctctcacagtccagggccggtataaacatgaccagacacgaactgcatcagaaagatatggtcatcacgcccctgatttttcagggacagtctccatatcagattataacgaatcatccagaactcgatatgtccgtgagaactctgtattcttaccttgataaaggaatcctgtccgcaagaaacatcgatctgaaacgtcaggtaaaattcaaaccccgcaaagtacacaagacccagatcaaagacagatccgtttttatcagacgtatgttttctgattttcaagcccttgaacttgaccattttgctgaaatggataccgttcattcatcacaggactcaaagcgtgtcatcctgacattcttcttaacccgtgaaaaactgtttcttgcattcattatgaacagatgcaccaaaggtgccgtaaaacttgtttttaacaagttggaacaccagcttggcacatatgattttttaaccttattcaacacgattcttacggatcgcggatccgaattcggagatccggagtctctcgaaaacggcattaatggcattatgcggtcaagcatctattactgtgatccgatgagaagcggtcaaaaaggcggcatcgaacaggcacataccatgcttcgaatgattcttcctaaaaagaccagctttgaatatctcacccagtgggatttaagaactatcgtagaccacataaattcaaccccaagagaaagccttggtggtcgaacaccatatgatgtagcacttgaaaactatggtatagacatcttaaaagcacttcagcttaggcctattccacccgatgaggtcaatctgacgcctaagctgatacgctttaaccactaacttagcataaaaatctgctgtcaggctggaacttaacaattcacattttttgaatgcggcctgtggaatttagtttcgcacagaaactattcagaggcttgtttgccatgcctgaaagtaagatgttttatggaaagttaatctaattatagcagttttataaggatttagcctcccacaattctaaaaaatcaaagaattttaaagcgtagtggaatttacccctgcactggaatttactttttcaagtcagcccaagtatccatgacaatgatgaactggctcgctcctggccattcttgcaacatttcatccaaagtattatgattcgcataatgctttaattttctctttgaggtcattgtatctcttttccgattcattccattttatatggtcaaactttttttcgtctattattcttattcccaattcaaacatctctgctttgttttcctctaaagctttctcattattttcaaagaaataccaagtaacaccatccgtaaagagaactgttttatttttagacaaatgtgcttctatttcatttttaacactactgtttccaatatccttcaaataatttaaagttttatctctaaaagacttacctttacgatcttttgtatttgatactatataatttgagctatcacctactgatttaatttcaacaactgcaatgtaactagtaggacactcatcttcttcattgttccatctccagtcttgtgctatacataaatctggagtccaatatttctcgtttggtccctttccacaatatttcccgtaattatgttttccgctaccactagaaactttaatatctacgggaataatgtcacattttggtaaaatacttttcaaaaatggagcaataacaaaatcttggaccatacactctcttaaatcattcattttgcatatatattcataattatccttatattctttatatttcatctcgattttttcatctcctaatacgatacatttaaattttctgttccctataaaattaatctatctggctttactaaatcgccaaacaacgatttatagacttctcgtatatatattttaccacatactttttccaaaagcactgacttctcaacccctaattttcatctgaaaattgcaaagtttaattccgccatccatttatacagtggaattctcttctgcacaagtggagtttaatctttcatatcataaatggtatgctcatgttggccttctgacagcagtagaaggagaactagcatgagcaaatatattcccggtaatcaaaaacatcttactctcgaagatcgcaaatacattgaaaaatccctaaacgctggctattcttttaaggacattgcaagatatctttgtaaagatccaacaacaatctcaaaagaaatcaggctgcacaggctcagcgactggtatcacaaaggctgttttaacaatgcacataacttttgcgtccacagatatcattgcaaaaaagtcaatgcctgtggcaagatcattctctgcggtgtcaaatgtaccacctgtccaacctgcaaccagacatgtccagactttgtcaaagaacgatgtaaccgactcgataaagcaccttatgtgtgtaatggttgtccaaaagcaatcaatcactgcacgattgcccacaaataccgctatgatgctatttttgctgaccgcaaatacaaagaatgtctctcacagtccagggccggtataaacatgaccagacacgaactgcatcagaaagatatggtcatcacgcccctgatttttcagggacagtctccatatcagattataacgaatcatccagaactcgatatgtccgtgagaactctgtattcttaccttgataaaggaatcctgtccgcaagaaacatcgatctgaaacgtcaggtaaaattcaaaccccgcaaagtacacaagacccagatcaaagacagatccgtttttatcagacgtatgttttctgattttcaagcccttgaacttgaccattttgctgaaatggataccgttcattcatcacaggactcaaagcgtgtcatcctgacattcttcttaacccgtgaaaaactgtttcttgcattcattatgaacagatgcaccaaaggtgccgtaaaacttgtttttaacaagttggaacaccagcttggcacatatgattttttaaccttattcaacacgattcttacggatcgcggatccgaattcggagatccggagtctctcgaaaacggcattaatggcattatgcggtcaagcatctattactgtgatccgatgagaagcggtcaaaaaggcggcatcgaacaggcacataccatgcttcgaatgattcttcctaaaaagaccagctttgaatatctcacccagtgggatttaagaactatcgtagaccacataaattcaaccccaagagaaagccttggtggtcgaacaccatatgatgtagcacttgaaaactatggtatagacatcttaaaagcacttcagcttaggcctattccacccgatgaggtcaatctgacgcctaagctgatacgctttaaccactaacttagcataaaaatctgctgtcaggctggaacttaacaattcacattttttgaatgcggcctgtggaatttagtttcgcacagaaactatccagaggcttgtttgccatgcctgaaagtaagatgttttatggaaagttaatctaattatagcagttttataaggatttagcctcccacaattctaaaaaatcaaagaattttaaagcgtagtggaatttacccctgcactggaatttactttttcaagtcagccctaattttcatctctgctattatacgttcttccctctgtctctcttcacaataatcccagaagtctttcaatgcttcctcatccgatttccacggcaatggtatggaatccaattcatctaatcgcttcacaaatttccgtacttcttcggtatcgaactcctcatcacttgcctccattacataaaaatccagtttttcatttatcattctgatttcttcgtctttggtcatgttaaaacctccctacattatatacatggcacttctcgacaaattcttacaaataactacaaattttttttcaagaaacgaaaaaaacgatactgcatagatttcctactccacacaatatcgttcttctatatttatactttcattgtcttcgccattatcaagttgtaatcggtatactcactgccaagcgcctcctttacctcatcctgttccttctttatatcaataaggcactgtgccacaaatcccggtatataaactttgcgctcactggtattgaatatctccaggaatggaaacgtaatggcaataaactcattctctggacttgccgtgcgggggaagccctgtcaaaagctgtcgaatggtaccgggaacagaatcttgaatttgatgcagttaatgacaatcttccggaaatcatcgaattctatggacacaacagccggaagatttcctctgattactatatcgacgaccggatgctgcttccggaaaacgcaaaggcatagaacccgtaatggggctatgcctttgtgcttattctggcattcatttttagttagtgcgggttatttacctaatacagtttttctcataataaaaatctgttagttaaactttttcaaattttgctacttcatccgataaatcttccgaaaggttcttattttcgtccgcctgcactgtaattgctgaaattgctgttacaagttgtgatatctcttgtgctacgtttgtaacaccttttgcagattcttcaatcgctatagaaatgttattgataccttcattcatatcattcattgtacctaagctatcttttgacttaactgcaaactcgttaaatgtattacttgcctgatcagaatcagcatcataatttccaataatttttacaaatttgtcataatcaagtgctaccttttcatctacaaaacgaatcatttccgttgcatttccagacagattgtttactgcctcaataacttttccactgatttcctgaatattgtttgctgtctcacgtgaactatctgcaagctgtctgatttcatctgcaacaacggcaaagcccctgcctgcttcccctgctcttgctgcttcaatcgatgcattaagtgctagaagatttgtctgtgctgcgatatttaagatattttctgtaagttttgcaatttcatttacagacttagatgcttctactgcctccgcgacatccttttgaatgccatcaaatgtttctactgttttttcttttgatgcaatcgcttctttatagctattttctgcagtaagcttcacttcatgcaacttcattgcagagttcttagcatcctcattcatgcctgccattttctccagcagattattacatccttgggctaaatcatatagagaagcagatacctcttccatggatgctgcaagttcttccgatgttgcactcacattggatgcactcatatttgaagattccgcctcattttgtacaagataggaagattttttcatatcttttgatacactctgaatctttaccataagattttgtaatgtttcaataaaatggttgacaccatttgcaagctgaccaatttcatcactggtttcatcaaatactcttaacgtaagattaccctgtcctgattctatacctaaaatgatatcatccaaatcattctttgctctttttgctggacgaacaatggacttattaataacaatcgaaagaagtacgattacaataatattagctaccacaagtgcaagatcaaaaatgatgcttccatttattctgtagttgctatgtctgatggcttctgccacttctccttttgctgtttcaaaaaccgcggtatcattatttttcactgcttcttcatattgttcaaactgttctataagcacattattcttttctcgaatagcttgtaatgccattaaattaaagactgtaatcaaaactgcaaaaaagcctacagacactaacattgttactaacttttttcccaagttctttctctttttcatgtttatttttcttctttctgcgaaaagcgccaatgcgttatgttttggaattttttaccatcatcctaccccaccccacaaaattttgtcaatactttattctcttgatagaaaattttaatctttactctgatgaggatggcgtgaaacacatccgtatcaaatccagacctaataaatggcatgagaatgactgccctttctgtcacaagtcatgtcctgcttatgacaaacattccagcagaccaaccacttggagggggctggactggggtggtattctggtcgaagttgaataccagacgcatcgtatcatctgccttgaacatggggtatatgttgccgaagttccatgggcatatccaggtagtagatttaccaaggatttcgaccttaccgttgcatggtttgcatcctatcttccaagaagtaccacatcatacttcatgagagtggactgggaaactgtaggccgctgtgtcaatcgtgctcttcacgatttagaaccggagcgctcaagaagacttgatggtctggttaatatcggcattgacaaaatcagttacaaaaagggtcacaagtagacaatttgtagacacttgcttctatcgcccattttctcaatatctgtcattcaaaatccaaagtagccagaaagtgaatacattaaatttattgacctggagataataatagcatataattaaagtacgtaaaaccatacgtttttatgtacggaaaggagtgttttatatgttagcagtaaagagcatggatgttagagataatttcaagagtttatgtgataaggtttttaatggtgaaacattaattatatcaagacccaagaacgaaaatattgttatgctttccgaagctgaatacaacgaaatgatgaaagccaagcgaaacgctgagtatcttgctatgcttgataaatctatggcagaggctgaggcaggtggttttgttactaagtccattgaagaattggaggcatacgaataaatgaatatagtatttactcctactgcttgggagcaaaacaccgaatggcagagggaagataaaaaaatggttaagcggatcaatgagcttattaaggatattgaccgcaatgggcttttaaccggaattggtaagccagaaccattaaagcaccgaaaagcatgtagcagacgcattaccgatgagcatagattaatttactatatggataacatccaaaatctgattatatactcatgtaaatatcattatgaagattagcactttaaacggtgctaatttttttacaatttctaaaggttcgcatattttcattagtggacctgctttgcactgtctccgcaaagttctccgatcacatcaatacttctctttcctgtattgtggtcaacttgaccacaatttttatccagtcaattactgtaatcagctataaaccttagataagtacagcttgttagcaactttttagctacagctaatatttggggaagtatgtaatgatactaactacatcaatcctatgactaccattcccttagaggtggaaatgatatctatatttaattgactagatttatatttataatatacaacgtgagcgtgtatttgtctatggaaatttcgactactttttatttttgaaattagaggattttccaataatgcatttccattaaaaccaacgcttccttatagacgctatattatttattctttccaaataggtgcaaaaaaagagcatttacggttttacggtaaatactctttttactgccaatattcaatttatatcattcggttttcataatcttgtaattcatggaaaatatcatccacatatacaacatcattttctattctgtacaacataaagtatctgtgctgttgaaaatttattcgacgatatccaaggctctgtaaacgtggattgtcgcatacattcaaactactcgctacatacttcaactttttaatagtatcctcaaaatcatcaagcacatttttggctgcctgcttatttttcttggcaaaaagcagatactgtataaactggttcaagtcttcttctgcttcagctgttacaactactttataatccatattttcctctcatatctgaaatcacatcatctgcatttcggtaatttcccttttttgaagattctctggattgttccagtctttgaagcatctcttcttctgtcatagatgtataaggattatgcacagttcgttttatttcaaatggaaatccattatatgcaaccgcctgcgttaaaaacatccttattgctgatgtcgtatcagttccaagatctttaaaaagctgatctgatttattttttaagtcatcgtctaccctgatctgaattgtacttgccattttagaaacctccttttttcttcattataatgccatttcattgctgattcaatacaattgtattgatgttttgctcgcttttattgaataatttctataggcatgatggagatagactcactacttttcattacttcattgtcttagccagcgaattaagcaacgcccgcatttccggattcgccagagctttcatcaataattccatatcgacttcttcagaagagaaattgacgtaagggaaggaaaagctatgattatacttaaagggttaaagaaattactggtattgccaattatattggttttagtttttatttggctgattgttaagactttggtatcactatatgagattgtacacggaatagtatacttgtttgtaatcatttttagcattcttctcatagctgtttatggcgactggcttcagacaggattactagctgtaatcggcttcacaagcttcttactattagcagtaggcgtcttgggagaagtgatgttagaatcgataataaagctgatttggagcttttaatagcatctagggaaaaatttgcttttataactaaaattataggattgggaaaaataatattgattgaaaagaagttttatgtttactaatttggaggtattgacatgtttacaacaaactcaggacgttttatttcatactatggaagagaacatacattagatatccaaaggcaggatggaaataatcccaccataagcacaattgatcagctatttaatgttttattaaatgtttggtgtaaagaaacggcttacccaagttgtcaaaaagattatgattatgataatgaccctacatacggacaatgtgcaataactgcatcactcgtttatgatctatttgacggcacgatttacaaattaaaagttgatggtggaggaacacattacttcaataaaatcaatggccactatattgatttgaccagtgaccaattcgatttatatgatattccattagaatatgttccaaatgaagtggtaccgagagaatattgcggaatgaatgctgatacaaatatgcgatatcaattactcgtgcgtaattcatgtatgccgtcaccagcacaaccggaagttttggatatttttctttaatcctcatagctgttttcagcccatccatcccctgcatattgatgtccagaaataatagctgacacgcttccaaagccgattgttcttcgcataactgttctccagaatcatattctgtaatagtaaactcataattctttttttcgccatagtctgacagcaaatctgacacattttttctgtcatctatcctgtcatcacaaataataatgttcatatttttcattcctgtctttgattgctctcatgcctgtaaaccatacaagtctcacctagcactctttattatatcaaacaaatcttccgctcgatcattctccgcatcaaatgactattttccgcatagaacgactatctcctatagaaacgcagaagcactgtatctcaaactctttgaaatacaatgcttccctgcattttctatatcgtcatgttgatattattactttactatcctgcacactctctgggagtgactgtatctatcaaaaaagaagccagcagtttattcacgcactactgacttcctatattattcattttatttacttcgctgcgtctcagacaagttttccatctttaaacacaatctcttgccctccaggtatccgtcctctctcttatctgcaccgattacctttgcgatggactgcgccaccgaaggtttctcggcaattactaattttatatttttttcactcaaattttgtttccttctttcattttttatttgctttttgatagcataaatgctatcatgtatatagaataaatatttccacttggagaacatatactaatgtacaacattgaattttacgaagattccaatggcagatcagagctttgggaatttcttgaatctcttcgagtcaaagcagctacaaacaaagatgcccgtattcaatacaagcagataagtttgtacttccagctcctcgaagataatggtacacggcttaatgaaaatatcacaaaacaccttgatgatgatatctgggagcttcgcccaggcaataaccgtgttttatatttttatttcaaaaatgatacctttgtgcttttgcatcaattccgcaagaaaactcaaaaaactcccaagcgcgaaattgaacgggcaaaggctgaacgtgatgattaccttgcccgaaaggaggctgaatgattatgaaaacctggaatgactataaggaacatgtaagaaccgttgatcctgaaattggaaaagacatcgatgaagttgaaaatatttcctccatcgtaagtgccatggtggaacagcgtacttctcttggacttagccagagagagcttgctgctatgtgtggtattccacaatcatccgtagcacggatcgaatcctgcaaaacaaccccgaatcttggaacactgcttaatatttttcaacatctcggtctgcagcttacagtaagtcctacaaaacctaccatttaaaatcaaggagaatctctgcaaagaggttctccttatcacatttcttcaattcacgtaaaaagtccgtccagaatagattgatttatctaatctgaacggactcttttaaaattctgaagtgttccctgcgggaatcgaacccacaattacagcttaggagttcaagcccccgttggaaacctatattattttgagttaggataagtcaatgaaatcattgatttttctacccttcctgtaaatccatgtcaaaataagaaaactgaaaatcatctaagttaagcacctctcgctgacaaatgagtgacattgtcaccctgagggttcaaccattccgttcctacgaattcatatttatggctaccattctcatttagcaatgcagtaatgataacactgttttcttattagattacttatattataacgtgtacgaggtcggatgtcgattgttttttgaccattatttacttctgaaaattgcaaagtttaattctaccatccatttatacagtggaattctcttctgcacaagtggagtttaatctttcatatcataaatggtatgctcatgttggccttctgacagcagtagaaggagaactagcatgagcaaatatattcccggtaatcaaaaacatcttactctcgaagatcgcaaatacattgaaaaatccctaaacgctggctgttcttttaaggacattgcaagatatctttgtaaagatccaacaacaatctcaaaagaaatcaggctgcacaggctcagcgactggtatcacaaaggctgttttaacaatgcacataacttttgcgtccacagatatcattgcaaaaaagtcaatgcctgtggcaagatcattctctgcggtatcaaatgtaccacctgtccaacctgcaaccagacatgtccggactttgtcaaagaacgatgtaaccgactcgataaagcaccttatgtgtgtaatggttgtccaaaagcaatcaatcactgcacgattgcccacaaataccgctatgatgctatttttgctgaccgcaaatacaaagaatgtctctcacagtccagggccggtataaacatgaccagacacgaactgcatcagaaagatatggtcatcacgcccctgatttttcagggacagtctccatatcagattataacgaatcatccagaactcgatatgtccgtgagaactctatattcttaccttgataaaggaatcctgtccgcaagaaacatcgatctgaaacgtcaggtaaaattcaaaccccgcaaagtacacaagacccagatcaaagacagatccgtttttatcagacgtatgttttctgattttcaagcccttgaacttgaccattttgctgaaatggataccgttcactcatcacaggactcaaagcgtgtcatcctgacattcttcttaacccgtgaaaaactgtttcttgcattcattatgaacagatgcacaaaaggtgccgtaaaacttgtttttaacaagttggaacaccagcttggcacatatgattttttaaccttattcaacacgattcttacggatcgcggatccgaattcggagatccggagtctctcgaaaacggcattaatggcattatgcggtcaagcatctattactgtgatccgatgagaagcggtcaaaaaggcggcatcgaacaggcacataccatgcttcgaatgattcttcctaaaaagaccagctttgaatatctcacccagtgggatttaagaactatcgtagaccacataaattcaaccccaagagaaagccttggtggtcgaacaccgtatgatgtagcacttgaaaactatggtatagacatcttaaaagcacttcagcttaggccgattccacccgatgaggtcaatctgacgcctaagctgatacgctttaaccactaacttagcataaaaatctgctgtcaggctggaacttaacaattcacattttttgaatgcggcctgtggaatttagtttcgcacagaaactatccagaggcttgtttgccatgcctgaaagtaagatgttttatggaaagttaatctaattatagcagttttataaggatttagcctcccacaattctaaaaaatcaaagaattttaaagcatggtgtaatttacccctgcactggaatttactttttcaagtcagccattatttacttctatttgctttaacttaaaaagccgtaagctaatgctcccagctttacatttttttattccatcagttttacaaattgttaaggaaacaatcggagttggtgtaaacgaaaaagcagtcttgcggttttatcaaactgccctttcgtttacatcaatttcgatttttccttggtgaacaaagtcgcgtccctttcgcaacttctatgggaattcaatctttgctctcttctataagtttatcatatctcgtgttttattgacagctggtttttgccaaaagaattatttttaggcatgacaaacagactccctttgcggaagttttttgaagtattcagttgtatattttaacatctcatatgcgctaaaacagatggtgtatgcttatctggaagatgtggaaccatttttccgccacaggaagaacacctgcatacatctatgttatatagcagctttatcatttcagtggcacttcgatttttcaatgcagaaatatattttttacatccaagcagatttctacagtgcgtcatctttttgctcttgtttcggcacgacagcaaaccatagtgccggattctgacaaaacgttttggtggaacatgcattaaaaatcgacggatgaattcctcgcccggaactgttttctctttccactgacctttgtttttatagtcttttacagcatatgtaacagttgcttccgtcatggacttgatccgatgattactgattgctatcctgtgagtatatttcccaagataatttatgactgactgtgctccattaaatgtttccttacaataagcaacccagtcttttttatagcactcatcgagaagtcctttgaagcaatagtggttttgatatttctccgctgtaccatgaaactcaagccttgaatcattccacaggctttttaattcgcacaaatatttcccacggaacacttttgcaatgaccccatatgggagaaaaaacttcccaccggtatctttccatttgctgtccttatcaagtccgccaccaagaacaattgtatggatatgaggatgataattcattgcagaaccccatgtatgaagaatacagatatatccgatgtcagctcccagatactttgaatctttcgccagctcgtccagagtggatgatgcagcatgatacagtgcatcatacaaaagtttctgattgctataaatgataggattcaattcctcaggaactgtgaatactacatgataatagggtgcatcaagtacgttctctttttgtgcatcaatccatttctctttcggaaactcctggcacatgggacagcatctgcttctgcaggagttattatgaatgctgatacatccgcagtcctcacaaacactgatgtttacaccaaaagcgcctgttttacagttcatgatatgataagctgtttttctatgatgagcaggagggctattcctcttttcataagaaggataaaaccgttcaaatacatcttgtatcgtacatgatttctccataatcattcaccgcccatctcatcaaatggactcctaattccaagcagagttttattgcttacatgcagataaacctctgttgattttggatcacgatgtcccagaagcgcttgaatatattttacatcacagccggattcaaacagatgacttgcaaagctgtgacgtaaacaatgcgtggagacgtgtttctgaatgcctgctcttttggcactttcacgaaaaaactgaatgacactatcttttgtaagataatcccctgtccatgaacttgggaacaaaatccctcttggtctgccacattgaaaccagtattctgtcaatatctcgagcgtccggtctgcaagcaaagtataacgatcagagcgacttttcccatcacggatgtgtatggttttgttcgtgcgtgaaatatcatcataatgaagatgtgtgacttctgaaacacgaagtccgcctgaatacatagtggcaatcatagctttgtgcttcagatttggcgtagcatcaagaatagctgatatttctgtttttgtaagcaccgttggtaacttcctgtcccttttcatacgaggtatgtcatcatcatcccaattcctcttcaatatttttttgtaaaagaagcggattcctgaatggtagtgattgtatgtttccggtgaaatcccggaaagtttcttttcagttaggaatatatcaacatcgtcagttgttaatgcatctatatccttggctgtgtggttcaaaaaatgagcaacactggtacagtatgcatgaatcgtggaatccttgagattccgtttattcgcagcagatcgaatctgattaaaaatttcttcgtacataataaaatcctccatgtaaaatcagtagttaatgaaaaaaactgcttacatggaggtgcattagcataataaaaccgcttgtcagaaaagcggtcaaatggtattcttttcataggcagtggtgtctttctgtattgaattgttttgtgtggtaactttacaatatcaaatactggtaagaattgccattgcctattttattattgagaaaaagaaagctgcgccacagccttggcaggccatcgcgcagcgattttgttcaacttgaagttgtcagtccttcttgttcttttcaatagcattaatagtgcaagcaaaacctgtaatcattgaaagtagtattgctccacccattgcttcgttcattccagcaccaaagaaaaaaccgaccaacgctgcaattaccataagaatgattgaaatgattactctcataatatatacctccataaataagaatttgactaattattgtgttttaatgattctataaactacccccaattgagcagggtatgtttcttgaatcattccattaaaccatattgtaacgatatctcccacctgaacattttccgctaaattttctgccgatacataatactctccatcattcatctgacaaaagccttcagctgtactcacatgcgttacaagaagttctccatcatcggtaatttcttttacttttgcattaaaattgataacctctattggaatagacgtatcatctttttcaatatctctaaatatgattcgttcgtcatcaatgactactatgagctgaccttcagaactcctttgataatgatatccgcttccgaaatttgattgattattttcagatggtaactctgtccctgccactgttgacacaatttctccatccattgttccacaaccaggcattgacgctacatatcctgtgtctttatatataacaccatcaaccataacacatggaggatatgagccagtatctgctatttgctcattttgtactacatcatcattttctttattctctgtttctacggacacatttccagacacaggttctttattttcttgattcgttccacatccagccattcccagcaccatacataatacaagcagatagattacttttttcataatacatgcctccttaacttatattttttaactctatagtcgagtagactaagacctctcaatcttagcccctcacagatccgtacgtgcggctttcccgcatacggctcctcatagtaactggtgctagaatataaatagtacaagccaaaatgagaaattccaaatacacataagcatgatacaatagaggcatgctgaaggaggatctcatatggcaaagcaacatgacaaacaatttaaacttgatgcagtccagtactatcaggatcacaaagatctcggagtacgtggatgtgcagaaaatcttggcatcggatacagcacattaacaaaatggctgaaagacttccgggaatcaggtgatattcctgttcgtggttctggtaattatgcatctgatgagcagaaggaaattgcccgtctcagacgtgaattacgtgatgcaaaagatgcacttgatgtgttaaaaaaagcaatcaacattctgggaaaatgacggaagccatttatcttgaagtgtctgagaagacggaagctgccaaaaaggctggacgccgggtttccgtctccggaatgttgaaatttttaggtgtctctcgctcaggatatcttgcatggctccaccacgtaccttctgatacagaaaaacgtcgtaaagctgtaaaagcaaaaatacaggatatttatgatgattccaagcagaactacggtgctccgaaaatcactgtagaactgcgaaaaaccggtgaagtcatttcggaaagaaccgttggtacatatatgcgccaaatgggaatccgtgctcagtggagcaaaccatggaccatcaccacaaaagattctgatttcagcacagaattacaaaatatccttgatgaacagtttaatcctgaccgcccgaatgctgtctggtgttcggatatcacctacatctggacaatagacggatttgtctatctgaccagtattatggatttattttccagaaaaatcatagcctggacactttcagaaacactggaagtatcctgcgtgattgatactataaacaaagccaaagctcgccgaaatattgatcaaccattaattatccattcggatcgtggcagccaatatgttgcaaaggaatataaaaaagcaaccgaaaatatgcagcgcagttattcgaagaaagcttttccgtgggataatgcatgcattgaatcctttcattctattatcaaacgtgaatggctcaatcgctttaaaattcgcgactataagcaggcataccagttgatttttgaatatctggaagctttctacaatacgaaacgaattcatagccattgtaactatatgtcaccaaatgaattcgaacgattgtatgaaagaacacacactgaggctgagcttctggcgggttaaaatgggaaaagtttctcattttaacttgtactaaatcttgacataggaccaaacattcgcttcaatataaacaatagtacgttttaggttttgctaatgggtaatactttagcatttccacaaatccattccatgtgtatgcccgtctacaacctctccgattcatggctttgaatagaaactgttgtactctatgcaggaatgttgttatcttccgaaaattccatgtaacaccataatatcgatagtgtccaattagttttacgttcaactctttaattatttctcgcattggtcgatttcgattatcgtaaatccagttcttgtatgctctaaccttttgctcaaacttctttcttgaagtctgtacctttggcacgaaacctccctttcgagttttgctacagtagaagataaaccccagaaaatcaaatgtttcaggcttacattctcctcttgctctacgattctgctctgcaaatctcccaaattcaattagtctgcttttactactttccagctccagtccaaacttttccattcgttcctttaactctttatagtatctttcagcttctgacttatattgaaatcctgcaacaaaatcatccgcaaagttgacgagaaaacactctccctgcatttccctttgcaccaccagcttaaaccacagcgtcagcacatgatgcatgtatatatttgcaagcatcggactcattactgagccttgtgccgaaccttcctctgttggctcgaattttccttgctccattattcctgctttaaggtatttacgtattagccacaataagttcttatcctgtatattccattcaaggaacttcatcatccaatcatggtcgatatggtcaaagaaacctttgatatcggcatctacgatatagctgatttttccatagcttatccgttggtatacttcttttattgcttcgtgacaccccctattcggtctgaatccatacatgcagtttaggaatctcggttcataaatagctcccagtattttcttcactgccatttgtacaatcttatcttcataggaagcaatccctaatggtcgcttctttccattttctttaggtatatataccctcagtgacggaagtggcttaaaggatttgtttttcaacctctgtaccagttccttgatatttctatcaaggttcttcccatactcatccttagttaccttgtcaattccgactgctttgttcccatctaattccttatggcattgctttagcatatcttcatttatcaagtggtacactgatgtaaatatagggtgttttgatgttgccgatatctcagctattcttactaatttcgtttccattatttcctccgtccctgagtacggataatgtgtcctcagtaagacctttactatgcaatccccttccctccatcggcattgcccgatttctacagtactatgggattgtccgaccacctaccattcatttgaaatactccgttttcagttgcaatttcatactcttcttcgagaaatggcaggttctccccagttgatgtgtattcataatgtaaaacatgattggttctctgactccgcagtgccacataacactcgccatatcgcattacatgatattgtcttccgcaccagttaagacgtcgaccgactgaagttaacgtttcgaagctcaatcactattcaaccctgctttcttgctgtctacgcttgtcaggtgccgttaccggcatcatcccaagactcgctattatctggttggctaaaccttggataaaccggaatcccaccggcttgactacacacccttagctgggcgcacaactggaagttgtctctatcagagtccgtaatgaattacccacttgttattgcttaatgcattttctaacagctttttcagttcggatagttcagaattatctgcaatgacatcaataaatgcctttagcgaacaaggtggaacaagtgtaacaccacagtatgcaagccctttgcctttgacggaaagtgtatgccaatagaagtcaatggatgtaagcctttcgacaacgccttccaaataggcgtcatcaacagaaatacaggcatatttccacggctcatactcgtcatatcgcttgccctgctgaggagcatccatcataattccaaactcgtgttttgccatgtagatcacctccacaaatatcgattgagatttcacctgttttagggaatttaataactgttatattttgttattaaattctctgcaaacccttgaaaacactggatttatcgcaggtgagctttcccttattgtttcccttgtgttatatcgtcccgtcagtgtttacgaactctgataagggcaaatacaagggcaagaaaaatctataaaacagtataacacaaaataaaagtgacatggtgaactgattgaaatgcttctgatttttgtaacaaatgactgattgaatgataaggagattctatacgatgagaacaatatttgcagaatacaatccacacagaaacagcattgatatttatacttctgctggttatatgctccgcattgactgttgggaaaccgaaaaggatttaaaaaccacacccggatcagactgtgcattgaacgcacttgccattgataaaccgcttgaatatgcaaaattatatcttgatgaaacaatgcagatatgggtagatgcagaagattcattagaactatggtgaaaaatctttcattaaagtcacctcccatattaaacctgttatcttacctatatctttacgctttcctatcaaaagacgttttctcttccaaatagttcggcagttctttcaattctgagctttgggcattcttttgcgtatggtattcattgaagtaaattccgtaaaattctctttccttttcccgctcagccggagttctttcgcatccccatccataactatctcccagataggtcaacacttttgttccttgataagaaatgtcggcaccatatccttcgcctgtcagaatcggacattccagtgtgcctcctcccgccagagcaaacttcttttgcgcaaggttgttatttttcccctctgccctctccagaaaatcgagcaatgataattctccgattcctttgcatttcggattaccattttgactttttaccgcatttttagcctgctgatataatgcctttctgtcaggggatacatcggatatgtattctgcacataaccttgttctctgcctgtgaatagattctaattccgttttactcgtagtgttggcagctctctgagccagttccttaatctcagagacaaactctgcctgtgacttattgcttttccctgcacttggaatcatagaccaatcaggttctccacttctcagcgatacactatattttgtaatagcagaactcgttgcatttgaaatcgaaattcccatgaattcacctcatattttctaccttctctgcatatattttaacctctatatatacttatccatttatcatattcattctttaaaattctcataacatacttattttctctatttttttatcggataaaataacctgttctcctagtcccatatcatcaaacgaccatattacgcacacaaagaccatctctttacaagatgaccactgccttaaattcattttcatcgcaggaaagcaccatatcaccgccatatttatccacaactgcttttacatttaacaatccaataccgtgatgatcccctcttttgctctttatcgtatcattttcaatttccaccttttctgtcaccggatttcttatcgcaaatatcagtttatgatcttcgcactctaatttcagatgaatgaccgcttttccagtatttttcagtaccttttcactctcccggattgcattatctagtaaattggagagcaggatcacaatctcttcctcttccagacagatctcctgcaaatcccctactttcaggataaccgctatgtgtttctcctgcatgctgcggtacttctggtttaaaacagcattgaccaccggatggttcgtgttgattgccgacatctcaactgctatgctctctgtcagtttctgcgtaaataaaagtgcctcatttgtgtgtccattcttaatcaacgtctggattgtggaaagctgatttttataatcgtgcatttttcttcgctgacgctcatagatttcttcccggtcctgataatctgcaatacgattttctgattttgttccgtaagtaccgcaatttttattctctcttctttttcaatggtatcctgcatgaactccataaggataaggttaatcgcaaccagtcccaccgaaagaaataaaaatacattctgcatgtcaatacatcccggcatactcatatcagtttctatgccagcacatcaaatgtcgaaactccgctttctgtcactcctatagaagttgaagtacctagcaattccaccatttttcctgtcaggtcatctacatcttttccatcaattttcagattatattgccgttcttcctgctcctgtttttcggcacgctgtttttccagtctttcctctgtctctttcttttctgctttccttttctcgagtctttcttcaagttctttccttgctttttctgttcccggatcaacttcatcttgagtacacattacagaactcatgctatcatatccatttatagtaatactataactcagtatctttgctcctcttgctgccacataagctcttgactgttctattgtttttggtattagcgataaattgtactccaaccattgttttgtcttttcatctcccatagcctttgacaaaagagagctgtttatatttacggaataatccctgcttcgtaaacaatcgtatttttgtgttaaatagttcttatattcatgggcattcttatatgtcctgcccgttttgtttccagcattttgtgtattgccataactattcgtatatgacgcatatgttcctattcctgtaactgccatattaacatatctcctttcattattcggagtccttccaactatgccacctgttggatttttctcacctacatctatactttaaaatctaatccaccaagagtatcatccatctgatctaaaatacttgtatcaaatgcatctcccggcttccatccaggattatttttctttaccagtgtctccattcttgaagcataatctccagccattctgctcaatgtccacgaagcggaatttcgctgttcagaaggaatcgtattcaaatactgtttgattacatcatgtctcttgctttcttctggtatatatgcaccattgctactgataaaatcctgctttacaaccttttctaaatccgacttcaccttatccgatacagacactatctttttccaatccttaccattgatacaacggtctgcctgttcctttgataaaaaaggtacaccatctttattatagtaataattgttatttctatattgacacccagaatctacggtcgtaatcccagtctgcttgtgtgaagaatttttctgaaagaagaatttgtttattagcaaactttgcgaaaataaatttttattgttaatatttacattcatatttcactctctcctataatacaaaattgtagccacattacatttttaatatgtataatatacttttattgtttcagtggatgttgaaactgttccttttgtaacaatccatattttccacttgcctgacggatcaaaaccattaaaatcattaattgttattgttccactcttacttactgttgtataattaacatttccattgccatcttctacatataaataaaacgaatcacttcctgaactaaccctactatacacctctatttaaaattctgaattatgaactcaattccgttaccagtgaagaatatctttttgtccggttctttatatcctcctcactgacaccataataacaatataaatctctggctattttcttaaacctttttatgaccgacttatttccagagtaagatattccaaatatattccaggtataatctaccgctatttccattaaatcctcagcaatttttatttcatataaatgaaaatccatgggaattacattatcaggcatttggtcaatcagtttatttctaatttccatttcattcaaaaaatttttaacagattcttcattataaaaatctggttttggaatatccttcctttcgcccaaaagttccggtttatgctgcataatcaaactagcttttagatttttctgttgttctatccaatttgttgcggcaggattgatttccactaaatcataatgatcctttgcgtattgcaccacttccgcaagggtatgcgggttggccgctattctcttttctatcctttttcgtctggattgatagatagcttttcggattctaatctttagagattgcttttgagcttctccaaatataaaaacacttgtgggaccatcttcaccatttattatagaaacttgattgatacttttatttttcataagtgccctctactcacaaatcccgattatatcggtgattcacaatcttttagccaaaatcgcagttccataaccgtcacagcaattttatactttacttcgatttcaatcttttctggtggattgactaaaagcctatcaatatcattttcctcaacaccagccatttttgctatcgttagcttggatatgccataataggaaacaagcacttccaactaatgcattgatttgatattttccttttaccgaaccttcttatgccttaatatcaaaactcgatctatcaggtacagaaatactcacagatcctgctacaaggctttgtgtcatactttttacatcagtaccagttacggataaggtataatcacccgtttcctttctttctgccgatttttctgcacgtttctttgcagctttttcttcctctgcttttttagcagctcttttctcttttactttttcctctttttctctgttctcttttgcttttcgttcagcattctctttcgctattttcccatctggatcatttgtaccagatactgtctctataatatttccgtttgcatcaatcatataactctgatttgtcacagtgcccaaacatccattaatcgtatcttttgtacaatccggaatggctgctaagttttcctccaaatactttgctttttccggatcattcatgcacttttgtaaaaatgcacttgaaacagataccgttgtcggaataccctgcattgaagtcagccctatattcatataatggtattttccttgcaagtattttgaataatcatttacattactataccctgtcttaatctgctctgtttttgtcacaccgggacgtgatgtttttaattcaactgtacttgttgtcacgttgccatcttttgtatttgtactatccttttcactatctgttttttttacagtattcttataatttgaagcataatacgatgtgtaactgctgttattgatacccgtaattgccataatcctacctccctgttattaaaacttaaaataatttctattatattgaacgacttggatatttaatttccgttgatgtaaattcatcttctgccgaaacattgatatgcccactgctgtcaatagcatactctttaccataaacggaaaacgtatctccttctttatatccaatttctatccagtttatatcatttaactgttttatctttgcgtcaacatttatggtttttcctgattcctgcaataaataagtgtgttttcctgctcccgcatctatagaaaagaatcccggagaaatcccgactttctcacagactgacagtacttcctcgttactgtagagataaccccacacactctttccctgtgccagatcagataaaatattacttgctttgcgcatttcccacttataatttgtccctttttgatttgtattctctgcaagcaacgattccgaggctgcccagcctatccttccattgttgaccgtccatgtatatttaccgccacttgatgttgtccatgaataataacttttattacttaataccaaagaattatttgcagcacaaatgcctgacatggtgcttgtattcattttcggtactgcataattaggtactacctgtctgctcccattaaggtcaaaggaaataaccccgtactccttaaaatcagaattatatccacaggaaacattctccccaaaattgattgcatccaaaatagcacttgaattattatagtttgcaaaataataagctaattcactgttagaaatattcgcatttttatctatcagtgcagctatggattgctttgaaaagcctcgtgcagcatcagaaatacttaaactgtcctgttttttattatttcctgctccaagcaacatctgtattgctttttggtgtattcctgcctctgcctgctttgaatatgtcaacagctggtttactgtgtttacatctgttactgtcttcataattattctccaaaccctttttcaacattaaacgccaaacatatgctgcaatttgtccagcatattatttactctgccttcaacagcttctggctgattccttaattcatacctgcttccatagtaatcatttaaacggtctttcatctcattacaaaataatttttgatctgttttaccatttaaaaactgattgcagataccacttatctctttcttctcatttgtataaaaagctgtctcatctgagattatttctgacttgtacttataagattctgttttgcttccaattccaacaaccatgtaatctggtgtcattctctccatgatggaattacgtgctgaatcattaaaatgaacatattcgtcaatcatgtctgaaaaaccagcttgaaattgctctggaacatacatttcatttactttccttagcccagcttcacttgcacttaacaaaaatacagattcataagaagttcctctatatccctcctgagcattcaaagaatctacatctgctgtcattgcattaatcttctcttttaaatctttcatttcatcttctgtcaaatattcagaagcattttcgtccagccatttttcaaaaacctctgactgattttccgaacagccttcaaacgcactttgttctccagaaatggaagttgctttcaaatctaatttgaataaattttcacatttatattctgctggtatctctcttatctctcccataatagatgaaaaatgcattgtatgaaaatccgataccttattacgagcagtctcaactaactttcttgctgaatcactgattttcacatcatcctccgaaataatattctgaggaacagttgttttcttctcaaccttattttttatcatctctggattattaatatacctatttccttgaactttcatagcaacctccttaagttagtccacactttctatacttctttatctatcttgctcgatgtcaaagaacctgcatctattttcaggtaatctacatcactgtcattgctcaatgaaccaataaaacgatttatatctactgactttctgccactctactctctggtgatgccatactatgcaccaattagatatttttcttttatcaaatcctcttatgccttaatatcaaaacttgatctatcaggtgcagaaatactcacagattctgctacaaggctttgtgtcatactttttacatcagtaccagttacggataaggtataatcacccgtttcctttctttctgccgatttttctgcacgtttctttgcagctttttcttcctctgcttttttagcagctcttttctcttttactttttcctctttttctctgttctcttttgcttttcgttcagcattctctttcgctattttcccatctggatcatttgtaccagatattgccaccgaaatatttccgttttcatcaatcatataactcagatttgtcaaagtgcccaaacatccattcaccgcactttttgcacaatctggaatggctgctaagttttcctccagatactttgctttttctggatcattcatacacttctgtaaaaatgcacttgaaacggatactgttgtcggaaccccttgcattgaagtcgttcccgtattcatataatggtattttccttgcaagtattttgaataatcatttacattgctataccccgtcttaatctgctctgtttttgtcacaccgggacgtgatgtttttaattcaactgtacttgttgtcacgttgccgtcttttgtatttgtactatccttttcactatctgtttttttaacagtattcttgtaatttgaagcataatacgatgtgcaactgctgttattgatacctgtaattgccataatcctacctccctgttattgaaacttaaaataatttctattatattgaacgacttggatatttaatttctctcagcctcaatatgatatgtaattactatttttatttgtaaatcatagtactaacatcatcaaatcttaatgctcatcaataactgctctctattaggctgaatcattgtatatttctccttaaatgaggtaattgcaccatacattttctcagttaaattttctgggatttcgtcctttcccctggttttttgctcctcaatgtaagccgatgccaaagttgaccttgtggtaatttttgaaattttattcatttcttcaccaataattccacgggcatgctgattggttgtctccattgtcacaaagtcatccactgtttttttatatgcagcatctaaattgcttaactcttcatcctttgtaagcttacgaggtccattttcatcagctacatatatttctctggttccattttcatagcccttcacaatttcatcatataattctgcgtatgctttaacataattatttgccttgtcagtaatatttaaggcactttttcctgtatcaacattttgattctgctgtgctgccttcttttgaatttcataactataatcaatatcactgatttttttactcgctaacagttcctttctttgaaccacatcatcatatttttcctgtccactctgctgtatacgattacgataatactccaatccctcattagaaatcgaaagcttcactgattgccccactgtatgtttttcgtttgtctgactatttcctttctgtactttatcagtatttttttccattattgaattcgtattattcatgtaattagatattttcatatcctatttttcctccttaaaacccattatcttagtttcacctcgtggctcacaaataaatctatctataactttatatctactgacttcctgccactttccgccgactcccttgtaataccatccaatgcgccagccggtattggtttaccagctctccatgtaggatctgcgacttttgcagcttctgcaaatgcctgtctgtattgatgttcatattgttccattgtccagcctgctgataagcggtcatccttatccatttttctgtataaattgttatatacactctcccttttggtagtatcaccatttaaagtaccattttcatttaagaattctttctttgccagttcaaacatttcttcccggctgctctctggaatagaaatgatatgtttataactgtttctgttctcatccgttacagcaagtcctgttaatccggtattcggatcaatccagtctccatttttgtcatactggctcatcaggttcttaattgcctgaacatttgtaaacattgcaccgtttccatttttcatcatctcactcagtgctgctttatactttttactgtttgtgtcgatccctgctgcttttaattgtttctgtacagaactgctgttcatttgggacaactgaatattgttgaccaaatttgtttttgatgttccaaatgttgtttgaaataaaaaaccgtagtccgtaattcttgacataatcgaaacctcccatcattaaattttttatatgtatcatccactttatttttttctatcgacacaccccttctgatattttaccttttctgcaccaagtacgatttttttgcacgaagtaagactctttacaaaaaaatagccaaaaatgctcttttatgaattaaggaataactcagcagcaaatttatttccatcattcttcaatgttaaatctccatcatatttttttatactgctctgaacattcagcaatcctattccaccattttttcctttatttgatactggaaaaccatttctccactttacttcattacaattattttcaatgctgacaactatcatcttatgatatgaaccaatcttaatgcaaatatatttctcgcctttcagcttttctgttgcttcaatcgcattatctaataaatttccaaaaatagttgtaatgtcgattggttcaatgaaattcaaattcacattatctacctttattgttactgaaatccccttttctctcataacagattctttatctgtaagaagtatattcaagatcggattttctgtgtattgaaccggaatgagcggcttcaacaactctctgatctttgttgcatattctcctgccgttttttcctgctctgcaccatataacccttcgattgctttaatatgcttatttacatcatgtaatatctgaatggtttgatcatacttttttgcctgggtcaaatagtattcgtattgtacctttgcctgctgctctaatgcgatcaactgcttttcgtaatagttcttttcatctgccatttttacaaaatataaaaggtataaatctgccagaacaatacatcccatgttgactgcacacaaataattttcttctccatttttaaaattctctacaattacactcatgttaatcagactgtatagaagtataattccatacatgatgtaccgtgtctttgaataagggacatcactttttttcacaaacctgtttatgaatgtgtaatacaaaaaaataagtatcacctttgaaaatgttacctcaaggcaataaagcatcgtttcattcacattttttatatctgcggcttgcaaaatgcattgtaaaagaatcactcccaatgattcacagacagacatacaaaatactaatgcttcacattcaataatacgtcttaagggtttatctatatcctcataatacagaacatatactataatccccgtcaaaacgccccagactactagatttaatatggaatgattgagcatatttatacagaatgtaaatattactgtggtagtctcaatcacaatatatacatatctatttcgactactctttttatactttccattcataaactgaaataatatcgtacttattataaaacatgaaagtgcattacataataccagtaaaatcgtattcatttttcctcctatgaatttctctgcaaaaatttatttacttcttctctaaaatcgttgcttctcctttgtgcaatcagaagttcttttccattatccatataaataataaagccctttattttttcaatatgccttaaattaaccagatttcctctacaattcacaacaaaatcatatggttgcagttcttcaaccagtttttcaaagatacaatcatactcatatgtaatatcagacaatgctatcagtacttttctggatctttttatgtattcaaaatataaaatatccctcagtttcagtttgatcgacagatactcttttccattgctgtcagtcactttataaaaattcttttctactatggcatccggcagttgattcagaagttccaatatctgcaattccagtttatcatattccaatggtttacatagaaatgaaaatgcatgaacttcgttaatgacctgcatacaatattcttcataactcgtaatatacactaatttcacatctggaaatttttctttcaattttctccccagtttaataccattcagttcttccatcgaaatatctaaaattccgatatcaatacgactgatattttcaagcatttgatttgcagacataaatttctctatatgataagcaatcttttgacttgtaaaaatcttatgcagcatattcactgcacactcaagatctgctatatcgtcatcacaaacagcaatttccagcatattactcaccttcttcctatcttcctactatatcggtaatttttatttttccattaaataaatataaagtactctgcatattatctaaataggctctaaataaatatcatatatatagaaaatgtgccatcatcttgacggcacatttcctatattttccccccaaattatattgctacagtatagaataccattgtctgtccatactatctgcttcatactgatatgtaatcaactgattcatgtcttttaaacccgccatttctattaggttctatcattatattatagttttcatatttttatagtatcctgcattatccataacactattattgccagatgtacccacagtacttacctcagagtccgaaatattataccctgccttaaatgcaagaatatcctccaatccatattgatttttataatccgtcagcatatagatattatctcgtatttcctcatatttcgcattggcttcctgggagttcattattttacacattttctctggaagtccggtaatcttcccattgtcatctacgtttatatcgtcaaatgaatactgtccatttgttgctttctgaatgaactgttccacttcatagtaagcatttactaatctatattgtgtgttagaaatatctgctgtctgaatatatttttcccacatatcatcagcaaaattttccgatatcatattttttatctgttctttgttttcttctgtaatgtccccgttaatcgtaatagttccagatacatctatttcaattttccatgatgtatctggcagttcaattcctttttcatttgctattctttctatttctgcataaaaatcgttttttatataattcgacttctctgctctctcataatcagataaattggcaaatattttcacatatgccatttccgacacacttaactgctccccctttttcatcttatttaataattcttctacactatccgttcccgaatatttttcatcttccggcaacgcttcaaattgcatctgatgtaatttgtcaatttcgctttgatatgttttttcatatttctgctttattgcatttttttcttctgaattatctgcatttgctatttcttgtgagtgctgcacattactacttgaagtatccctgtttttcgtttccgtaatttttattctataggaaccttccccggaatccgatgtcatattggaattttctactctgatcacataatctgatgtaacgcagtcccaattaggtaccgtaagctgtttattaccatgtccatcatctgtcgctattccaatctgattgccatataaatcgtacaatactaaattatatgcctgactattcttgctttccaatgaaatcgttatctctgaagatatacccattttagagtaaaaacttttttgcggataagaaaaagaatagtaatctacatcatattttgaatcgattgttccctctaaataactttcattattatgcaacaatgttcctatatcatatgtactgtaatagcgatctacctgatcatcgtatttcgtatgctgatgataactatcattcttatttgttttggcattttctattaacaccgtttgctcatttaattctttcatcggcgatttaaaactttttgctgcatttcctgtctcatatattttactatctactattccgccacctatataatgtacatagtgtcccatcttatcgtcacctctttgaatccacggatggtataaaaataccatccgtaatttatttatctttctaaatatttagcccactattattccgaaaggaactaaataatccaatgtcatctgtgtcattgtagtgcaactagcatttacataagaaataccacttacccaatgtactgtaacagatgttgcatagtttccatcaattgatcctgatggtggattattgtcaaccaagtcactccaccaaccacctgtttgtgctagtttttttgaataactagcagttgctggcgtataataatagtcaatgcttgatgcgtatgtattattagcaaatacttttgatttatccgaaaatttcacacctgtcaatgcatactcatcttcacttccactaggacaattaatggtcaatgtttgcgtacttgctgattggctagatgagcttcgattccactttattgttgtataatgtgtaagatccgaaaaggttgttgtttgtgctattggcaatggttgtccagcataatatccataatgataaccggtagttgctgttgcatcttttaccttaaaaacaatataataatttccatcaataagacctaaactaattaccttattcgacgttcctgcaatcgttttagttgttgaataatatctgtcaaaataactggtaactcccgcctcatccgatgaacgatatattaaatttatatcattgtcaaaaataaatacattaacattagattctaacataaatgtaatattattacagtcctcatccgaaacaacacattgataataatgtccctgattttcatcatatgcagaatcattcagatacccctctcttaatgccgaattatagttgctctgaccttttggattcagtaagaaaccagacattacaaacccttctgatgtttttgcatatgtactaaaaatttctgtattcgatgtccatttctgatcagagaaattatattccatcgtgcttgcactccacatatatttatttgacacccttcttgtatctgcatatgcacttgctccatcatttgttgcatccgtaaagtcacaagtcacttcttcggttgcaattttcgattgtaataatgttaaatccgtgtcgttatcttctgtattgaaatgtactttattgccattatcaatacttgccgcattcgctactgagacatttcctaacagcaaacatgctgccaataatattgttgctatttttctctttttcatgaataattccttattttatagttttttgatttatatagattcattattaaaacgctttccctccctctattgtttattttttaatttaaaaatttcgaatcatatattttatctaaaaaactatattactatacttgacacacttccctatattttttcaaaaatattatatttctaaagtacagaataccattgcctgtttgtactatcagcttcatattgatatgtgatcaactgattcatgtcctttaaaccactctttccatataaaatgcttaaagtcatatccggcacattgttccatcctttagttgacatagttgaaaccaggtcatgtatccaattcttcatttgctgcttgaactctttcggaacttttccagaatcttcaacagccttatccactaagtctaatatattctctcctgactccgtataatatgtcccgtttttttcctcaagtttatctaattcatatcctgtataactataaacttgatgatatgcttcgtatttcatttttgattcctttgttatctgagaactctcacagccatcttgtgttgaacaataatatatatgcttatagaggttttttccgttatctcctacatttaaggcatcctgcatcaacacctttgtttcttcatccacgccatctaccgttatttcataactgtatggatcgacagtaaaagtacaatctttcgtaatagaagatgtatctacaccagcctgctttaaaatatttgaaatttgcgaatttatcaatgctctttcaaattggattttatccgaatctacactgtcaccgtccacttcaattcccctgaacaaagaatcctgataatttacaccatttatctttcctgtccggcacatctgcatctcataattatatgcaatcctacgttctgtatcagtcagattagtctcgtaatactctgaactcttatcaaaatacttggaatgaatataattttcagggttagaatgtgtttttgcttctgcggcaagcttagaatacttttccgttaatgccgccctaaatgctttacctgtactcatatattcacttgttttcgcattaatctgtgttcctgcattctcaatgaggtcttgattcgttttttttgctgaagctatataggactttaagtcaatgctgctgtcaatacttgtgttatgtgttcttccacttgtactttttgtcagtttttcctttcccgatgcacttatcgttaaagtatctcttgtgcctctacaaccagtgttttgactgcttgccgctttttgttgttgaccaaacagaacattaagcaacgactgattagcattaattcggctgttaaaaaatatattcataatatcaccaaccttcttattatatatcggattatcctaaccttgtttgtaatcttttctttcttcaaaattatagaaattgatactatgcatatgtatcaaaacctaccttatttttagttgtcgcttctatagcaatcatattttctgtttttttatcttctttttctttatcctctttcattctctctagccatttgtcaatttctgaatccgtaccagtctctccaaaaatgccacaggttgtcatttcggttccattatttgtaaacttaaactccactgatatcagtttactaccatgacttattgccgccttctgtgcatttcgtataacatctggcataattgctaaattttcctcaagccatttcgcagttttttcatctccacatgcctttcgcattacacttccgtcaatcaatacagaagcattttgcatgtaattaaaaaaattacaaatcttatgcaaacatacaatatctacctaaattatcaactttatatgcattattttcctgagtggtgccataattatcgccataatatatctttattcctttcaaaatttttgtccatgcacttatgtctgcacaatcattttctgccgccaaacattttctggcagtagcataacaggaacccggcatatcaatttcccatgctttgctggaatcaccatcatacggaatatatgtaactccattaggagtcaaaaatgtaaaaccatctttttcgcgtttcagatttcctgatatctcaagtaaagcatataatcctgccgtagaccgctgtgaacttaccggatatttttgaaattcatcagctaatttattcagcgtttctatatctttatcggatgttatgattaccgaaactccttgtgcctcatttccctttatcgacaaataatttaaccctgtctttggatcacgttttactaccaatcccccctgtagcggtatctcctttatatcaatatttcttttgtcagacaaatcattcaaaagatttttcagttcacttgtcatggttacattatacgaaaatggctgatccatattaatcaggaactccattcacatatgtagcatcttcaattttatatctttctgtctctattggtaattcaatatcttgagagatactattttgtgtataaattccaaagttactataatctgtactgtttacataggaatcccttgtgctaatcttattacttatacactcttgggctttattcattgtatcagaaaaatttcctactgcatttctattatttttactgcataacatactttgttgtaagtaaccattctctattctcatgattctccctcccaatcacttgggttttattgaatactccattataaactttaatcttttatctgaaatgtaccgtctgctataacaaactgtacatttaactcagacataatatctttgtgctgtatccggttatatgctaaaatttcccggatatcacttgcgtaatcctgataggtcagattcccacccggatgattcaacagatcatccagtgttttcggcagaccatgtatcgctgtattttccacggagaggtctccaagcgatactctgccgccagatgccttatataaaaattttcccacatccaccgcagcttgcaacagatatttttctttatctgacaactcctgtatttttgaatccgtgcaaaaataaatatccatcagctcatccgaatactttgacagaacattctctatcttctgtttcattgcatgatcctgaataccgtccacacttacctgaccatccgccccaatttttatggaaaacgtggaatctgaaatatcaattcccgcttcctgcagatcagcagatatcctatcttttactgtggtattcatttttgcacttgcattcgcacgatccagctctgctgcagtacaaaagatatttaaaagagcattttcctgttccgtcagttctcctcctgctgcttttttttccagtaaattatgaatctgctcatcatccggcactgccccaccctgcataacatcttctgcctgtttctgatgcagtttctccatctgctctgtataataggctttgtacttctgccggatttccttaattgcacgcgtttcctcagtatcggttaagccttcctgcatctgcttcctgactgtcccttcatacttctgaacctctgccatttcctgataagctccatggcttttatccgcctgcgttgtctggaaggaaagatgatattcggcatccgggtttaccgtcgaaccgttctttgcctgtaccttcacggtataacctctgttgtccgaattccagttcggtatggtaatactaagaccgccatttccattctctttcccaatgccgacctgattgccttcctcatcatacaaaaccatctcataatcacagccttccggtatatgatctaaagtgatcgtaatatccttattataggtatccttcgcgaaacttaatgcccggtactctgtaatattgaattcgtaatagtccacatcctccgtatccgataaacttccctttaaatatccgtccggcttattgataagtgccgtcagatccagtgttcttccaaacacatcctgatccgtatatttatttgttttccagaaataatcattggaaactttactattttctactgcaatatttttatcagtgggtaaaccttttttcttaaaatcatatcccacaagctgcgcatgcatctctactgtgcgggttattaccatctgttcattctccttgtgtataattacttttcataatcataatactttcctgaaactatacgcatacatatccgaatacatgttatcatgcggttggggcgtcagccttctatccaatgccgccatatccaccgtaaaaccactgtctgccacagaaaaagcaccattactgaatttaaactccgaagtgaagtctggaatccccagatcaccgcttgtcctattatgtcctataatatttatcaatgcatcctttatccgctctatcttggcattgtcttttgttttgttgatcagattagcggctttttccggcagcccgccaatctttccgtctggtgtcaggtaaaggttctccagagaaatatcttctcccgtaaccccttttaagtaacgcctgacttcctgcacatccgtggcatactggtaggtattggacgacagatttcccacactgtcagcaattcctgtgtaatactgatacatccggtcactgtacttttcctctaccagtttctgaacctgttcccggacttccttatcttcgattacttttatgaccatctataccaagttccgctattcaaaagctgtgacatactttcttcatatcttttcactgctttctgctgaatggaactaggcaccacataatcgttaccaacttcacttattttcccatttaccagttcgcaatgtgtcccgtttatcacaaattctctgcttgtatccactccctgtgacgcaagaaaatctaaaatataatcggtgtatgtatctgtcatacttgaaaaatactgctgatccgcaaaatgtatcagggagctcagaccacctatcatcatattgcatctttcatcatctgccttgcttccgtttccatagccctcgccccagacaaaatcttcctgtaccgtcatgctgtatccatttccaagattaaatctgcttccaaccccaatcgtgatactgtttgtactgggatcatatggtttgtaccctctggttttaaatggctgctgtacggttccaaaggtttgaatctcggatgggagatatgacatacccgtaattgccgtaaacgctttctgcccattcacataaaaggaagtatgggttgcactgtctatatccgctgtaatctcgactttctcatcattggcaaaaggattctgtccggtcattccggttccatatgcaaacagcattcttgtaaactgatatcttgtatgctcatcaaaatgattcagtgtctctgtatcttctccctttacatctccattgcaaaaatcaacaaattcatttttgctgccatcttttgtagataatttacctgtctttgtgttataaatgaaattataggaacttccaactttcgttatactcataaaattgttctcctttctgcataggagtcagtaatatgctctgactcctacatgaaatactttttaaaaatctaattcattacccggatatggctccataatacacttaaactttccattttttgaaatgctttcaactttcaccgaatcctcaaatgtgactgtcatctgtgtatcgtaagttttccattcaaactgctaccagcttacaccgttaccggtatgatcataagccttgattgcatcgttatattgcttttttgtttttctgaatattccggcacattttcagtattatttatttccaacaacattcttaaactatccggcactccatctatcgcttttctccacgcttcactctgttgctttgcaaccgccatctcatgctttttccttattatttcaatatttctcaaacattttaatacccgcattaaacaataaaaccaattttttcaaacagaaattcacaatatttatgcatatcctgatttccgcttcttaaaacagaagaaaacaaagactttatatctatatttcctcccgttctttcatattgctccagataaagtgaacggaactctaaataagaatcttgaatatagtcacatgcctgatttatatcaaaggcatcaaacgattcatccaattttgtattctgaaatttctgcttattttctgcattttgcttttgacttttggcaaccattttgtcccattttatcagttcctcaaaacctttatttagcttttccaattcttcatccattgacaacagacgtctttttccactctctggattatcgcatacatacacttctcttgttccattcctatatccttctacaattttttgatacatagtagaataggcatatgcagctcccattccaatatcatcgaaaccatacccatttttactttcacggatactctttaaatatttagtctcttcatcccataattcttgaagataatcctttgaccaagtagttttaggcactgtttctctaatataatttgcgtaaccagcgtctaaggcaaacctatcatgtatatatgcgttttcctgattttccccatcggcttcatctgaatgccctatcctccggcatacgtccttgccggatgttacggtcattttttcttgcgattcatttgccttatgctttttatgagaaagctctatagttttcacatgatcgcctttttgatgaccgtacaatgaagatacggtattctgaccaaaaccaatgtgcatacttctattcctccaatcagtttatctgaattgtaccgtctgctataacaaactgtacattcaactcagacataatatctttgtgctgtgtccggttatatgctaaaatttcccggatatcacttgcgtaatcctgataggtcagattcccgcccggatttaactgaattttcaacgcctaatcccatattaactccttttgttttgccattacgataatcacaaccgcaacactccacaaaatatttcattattctgacctagttttcccttttcttcggtcttttcggctggtgataaatcgctgaacactctgccgtcctgccaagaactgttttttccacttcattccgggcaattctctccactaccttcaataccttgtttgtaatcttttctttcttcaaaattatagaaattgatactatgcatatgtatcaaaacctaccttatttttagttgtcgcttctatagcaatcatattttctgtttttttatcttctttttctttatcctctttcattctctccagccatttgtcaatttctgaatccgtaccagtctctccaaaaatgccacaggttgtcatttcggttccattattcgtaaacttaaactccactgatatcagtttactaccatgacttattgccgccttctgtgcatttcgtataacatctggcataattgctaaattttcctcaagccatttcgcagttttttcatctccacttgccttttgcattacacttctgtcaatcaatacagaagcatttttgcatggagtcaaacatttatacttgttagtcaaatactttgaatagtctgatacatttttaaacttattggctgaattcatagtgtatcctgcataataattcttttcactattctttgatggctttacattttcattttttacatttccgtatgtgtatgtattggcatacgatgatactccattaattcccatactgcatctctcctttctatttagccttgattttttatttgcaggctattgggttttgttcgatacgcttactgccattgtaaaatttgcctcataagaagctactgcctgacttattgtgacagtcttagcagacgaactactctcagccaccaatcgagttctggcatcctgagcagataaccttttattttgcgcatattcttcataagctgttctttccgcttgttttttctgaatccgctttttttcctgttgtttctttacctgattttctattctctttttattttctattctgcgctcccaaaaactattttttgacttatcattaaaaatcttcccaccattcccattgttataaccagcactccacatctcagcatgacattcttcttttgatgctccataatatattgtagaaaacgctcctccgcatataccggaccatttatctggttgtgaccaacccacttgcaaatcatttaatacccatgcttcatactctggatcattcttcattgcttcaaaacccgcctctgaaattgtaacagatattgactcgcctgctcttgtggggtgcattggaatttgagatattttattgtaaatgtactgcttgtattccaccatcgtcatatctttagcagacacagaacctatttttgaattgcccactatacttccactagcttcgctcttttctcttacactatccgcaaaccttgtatcttccttctcctgatctttagccgcatttttctgttggtactgattgtaagcccgtgtcatatagttcacattaattgcattactcatagtaacctcctttgctttctttatcggataaaataacctgttctcctagtcccatatcatcaaacgaccatattacgcacacaaagaccatctctttacaagatgaccactgccttaaattcattttcatcgcaggaaagcaccatatcaccgccatatttatccacaactgcttttacatttaacaatccaataccgtgatgatcccctcttttgctctttatcgtatcattttcaatttccaccttttctgtcaccggatttcttaccgcaaatatcagtttatgttcttcgcactctaatttcagatgaatgaccgcttttccggtatttttcagtaccttttcactctcccggattgcattatccaataaattggaaagcagaatcacaatctcttcctcttccagacaaatctcctgcagatcccctacttttaggatcactgctatgtgcttctcctgcatgctgcggtatttctggtttaaaatagcattcaccactggatgattcgtatttatcgccgacatctcgactgctatgctctctgtcagtttctgcgtaaatgaaagtgcctcatctatgtgtccattctttatcaacgtttggatcgtagaaagctgatttttataatcgtgcatttttcttcgctgacgctcatagatttcttcccggtcctgataatctgcaatacgatttttctgattttgttccgtaagtaccgcaatttttattctctcttctttttcaatggtattctgcatgaactccataaggataaggttaatcgcaaccagtcccaccgaaagaaataaaaatacattctgcatatcatcgttttctgaataaaacataagaatgaaaccgaccaccgtaaatacaggaacacagaaaaactgtaaccattcttttcctgtaatcagaccgcagctttttcttgtcttgctaaatcttctgataaacaacatcagaatgataaaaaccgtctttgatatcagtgcctgtaaaaaccatttttcttggattgaacctcctcttcccagcaaaacagtcacataatcaatcaatacaagcattgtatagttgatgattgaaaacaaaaaactctgccggaaggagacctcataataagccagatttaggaaagacataaccagtataatcgggatacattttaacattccgatccatgcccctgtgactgctgccagataaagcactccgcaataaacaaaaaatctatatctgttcctatatccgccatctcttttttccataaaagtatcaaaaaagtatagcgttccttttacttccagcatttccgcaataaatgtcaatacccagaatgtcatgttattcttctcccttatacagcatatattccctctttacctgtgcatatcgtgccttgggaaccggaatcttttttcctgtcgtaagtgtcatcacataactgctgattttggtaatgtatttcatatttacaagaaaacttaaatgcgcccgcacaaatcccatatcctttaattcgttttccagttcatccagttttttataaatctgaaatgtccctttttctgtataaaatacatttttgtgaagctctgtttctatataaatgatgtcatctgcataaagttttatcgttccttccacaaaacgaaattcgagaatcctacggtttttattaatttctgctatcaaatcatccatacattcttctatagtatctgcaaggttatctttcagcagaaaacggcttgctttcaccttatatccatccagtgcgtaattcatgtatgccgtcacaagtacaaccggaagttttgggtatttttctttgatcctcatagctgttttcagcccatccatcccctgcatattgatatccagaaataatagctggcacgcttccaaagcagattgttcttcgcataactgttctccagaatcatattctgtaatagtaaactcataattctttttttcgccatagtctgacagcaaatctgacacattttttctgtcatctatcctgtcatcacaaataataatgttcatatttttcattcctgtctttgattgctctcatgcctgtaaaccatacaagtctcacctagcactctttattatatcaaacaaatctttcactcgatcattctctgcatcaaatgactattttccgcatagaacgactatctcctatagaaacgcagaagcactgtatctcaaactctttgaaatacaatgcttccctgcattttctatatcgtcatgttgatattattactttactatcctgcacactctctgggagtgactgtatctatcaaaaaagaagccagcagtttattcacgcactactgacttcctatattattcattttatttacttcgctgcgtctcagacaagttttccatctttaaacacaatctcttgccctccaggtatccgtcctctctcttatctgcaccgattacctttgcgatggactgcgccaccgaaggtttctcggcaattactaattttatatttttttcactcaaattttgtttccttctttcattttttatttgctttttgatagcataaatgctatcatgtatatagaataaatatttccacttggagaacatatactaatgtacaacattgaattttaggaagattccaatggcagatcagagctttgggaatttcttgaatctcttcgagtcaaagcagctacaaacaaagatgcccgtattcaatacaagcagataagtttgtacatccagctcctcgaagataatggtacacggcttaatgaaaatatcacaaaacaccttgatgatgatatctgggagcttcgcccaggcaataaccgtgttttatatttttatttcaaaaatgatacctttgtgcttttgcatcaattccgcaagaaaactcaaaaaactcccaagcacgaaattgaacgggcaaaggctgaacgtgatgattaccttgcccgaaaggaggctgaatgattatgaaaacctggaatgactataaggaacatgtaagaaccgttgatcctgaaattggaaaagacatcgatgaagttgaaaatatttcctccatcgtaagtgccatggtggaacagcgtacttctcttggacttagccagagagagcttgctgctatgtgtggtattccacaatcatccgtagcacggatcgaatcctgcaaaacaaccccgaatctcggaacactgcttaatatttttcagcatctcggtttacagcttacagtaagacctacaaaacctaccgtttaaaatcaaggagaatctctgcgaagaggttctccttatcacatttcttcaattcacgtaaaaagcccgtccagaatagattgatttatctaatctgaacggactcttttaaaattctgaagtgttccctgcgggaatcgaacccacaattacagcttaggaggctgtcgttatatccatttaactaagagaacaaatgccgattaccggcagttcctgacaatttattcaaggcaaaggtttccctgcatccagacatttccacgaaaccgtctgcctatcgcaggttcacccaataaatctttttcattgatacacacatcgaactgaatgttattgcacaacaacttcattccatacaatttttcgtgtgtaagtttattttccatcgtgacacagtcaatgatttctcccaataccgtatattggtcactctcaatcccaaacggcataaacgttgacttcacgatactgaaaatatcttccttcatcactctctgggacagcagtgcataagtatccatatcctccagcgtaaggctttcgattgcatcttcatcgccttctcttgcctgtgcgatcagctgattatgccggtcatttttctggatagccggtacatcatttttttttctctccacaacgggacagagtatttttccctcggtggaaagtcctgcaagcattgccccataatgtattttggaaaggtgtcggtttgtctctgccagataatccgctacattctgtatataaaaaatcagtgtaactccaagattaacctcgtcacatactcctgcataggactctttctcggcatgtttttctacatcaatctgctcattcgtcgtaatactggtaccaaacacatacggatagtaataatccatatgaaaactgtcatcttcctgataagtaccccgaaccgtaattccggcatttgccgcaaatgaacctgacagttccgcaaactcgtttccctcagaatcttttgtaattttcataatctccggacgggtaattacttcatccagtatcatttcaagatctttttttgtaatatctgaaaatccaatcgccctaaggaatttgtgcacttcgcggttctcctttctccatacattactacattctatcatattatttgaagaatggaaatatccttttgtaacattaaattatattttttttctgactccccggaatgaaaatccagaacaaccggacacttcggatcctctgtctgcaaaacgacaattccctctgcctgattactcatcttcactaccgttcctaccggataataggcaatcttagatagcagggtttccaccactttccggtcatacttgtgtatgattccttcctgtatctttccgattgcatcctgcaggggaatccgtatgcactccatgcccgtaatataactgtcaaatgcatcgcatgcctgaataatcctgcattccattgcaaaatctctgcggcgcatcggaaacccgcttccatcaagtctttcatgatgaaataaaaccatcttttttgatacttccgggatccagctttcctcatccaaagcggaatatcctaaaatggtatgttttttgtactcaaatgcttctatgggatcttccttttcccaatcccggttcacatatcctgttgtgatataacggagtccgagatcatggagcagtgccccaactgcaatattatattgcctcacctgatccagatgcaacaatcttgccacaaatacactcacaagtgttaccatgacagtatgttcatataaatttacaatccgggcattgatatcaataattatattttccggtattttgcttacttcttttacaacttcatttgcgattacttcaaattcgcgcagcgacttattcttatgatagatatggttttccatcacccgctgtacgcgttccacaaacttaccgaaaacagaataatcaataatccgcgatggcatttcataattttcatacggatcttctaccataagggtgtcaatcccaagtgaacggatcaaaggaacatattccttcttgagcctgcttcctcttgaaattaatatcattttttcatctgtaagaactggttctgctaatatttcatttccacacaactcgcttactgattttaccctcatgttacactcccattattttgcaggattgctgccggtagattcttttgccatctttaaagcttcctgctcttcttctgctaatgtaataattgaatttccgtctataatctcttttatgtaagtatagcagccctctctgctgtgtactgcattgagaacgaatccattatctgactcattcaacattgcaagggaaaaactaagctttccacccatctcattaaaagcatcgtattttaccagtccgaccttctgaaatgtgaatttcatattgtcaaacatttttctgatatttttctcgtttgcttcatttgcagatatcagtttatcgacctgagacaaacgggttaccaaagtttcttccaatgattttgcatcttttcccatcatgaatgcttcatactttttacgcagtttacttgtctttgccatattcacaacggtaagtataaataaaataacacaaaaagctgctaatcctaaaataatataatcggaatcaaatcctaagtattctgatatcatatttttctcctgtttctattttcttacattctgttaaaattttaaataggcttttatccctatttttctacatttatttttgtatcgtccgaatcatgtcaataatccggtcaagttcatcctgggaataatattcaatctcaagtttccctttcttcgcatccttatggttaatacatacctttgttccaagaatgcctttcatctgctcttctaaatcatgatacacggcttccagtttcgggtcaatcttctctttttcttcttttttcttctttttttcattctggagactttttaccagtttctccgtatcccgcacactcaatttttcatcaaaaattttctgcgcaatgatatactgctgttcctgatcttcaattcccagaagtgcgcgtgcatgtcctgttgtcagcatctcatcaatgaccatctgctgtactttttcattcagtttcaacagccgcatggcatttgtgaccgctgttctgctcttggaaacccgctctgctacctcatcctgctttagattaaattctgtcagaagccgcttaaaagccagtgcttcttcaattggatttaaatcttccctctgaatattttctatcagggaaatctccataatttcctgtctggtaagtttcttgataatcacaggaatttctttgattccggctatttttgcggctctccaccggcgctccccggcgacaatctcataataatcctccctctcctgcaccagaagtggctgcaatactccatactgttttatggattctgccagttcaagcaatgcatcctcatcgaatttttttctcggctgctccctgttcggttctacctttgtgatattcatcatgatagcatctgccgcgtgctcactctttggtgttggattattttttgaagctaccggctttgtattcaccttgtctgtaatcagagaatccaaaccttttcccaatccttttttaactgccattgttactccctttctttttacaaatctttacgacccacgatttcctttgcaagcttgcggtaactctctgcccccgcagatttgctatcgtacatattgatcggaattccataagatggtgcctctgccaaccgaatatttctcggaatcatagtctcataaatttttgtatccagattttcttttacattttctacaacctgatttgacaatttcgtccggacatcatacatggtaaatacaacgccttccatctgcagattgggatttaatctctcctgtacaagattaatggtatgtatcaactggctcagtccttccagtgcataatactcacactgaatcgggacaagaaccgtatctgcagttgtcatggcatttaccgtcagcatatttaaagatggcggacagtcaatcacaatgaaatcgtaatcatcacggatatagtcaactgctgtttttaagatatattctttgtcatttattcctaataattctatttccgcacctgccagatttacattggatggaatcagacgcagaccttttacaacggtatcctgaatactctcattgatggaacattcatccagcatcagctcatataccgtattctcaacctcgtttttatccacgccaagtccactcgtcatgtttccctgcggatctaaatcaatagcaagtacacgtttgcccatttcagcaatgctcgctgcaagatttatcgatgtcgttgttttaccgaccccacccttttgatttgcaattgcaataattcttcccatattttcctcttttctttcttattctctgtattttatcagagtgtgtttttatttatcttttttaattttaaatgcaaaggttcttctccatgtattattctgtaaattcctttgcgatgccggatcagcataaggacagttgcaatcagtacacatacaagttctatagagtttccatgtataaaatataccgttggaattgcaagcgcaggaatgacaaccgcgcccagcggaagccatccggtaagtagcactaccatgcctcctattatgcaacagattgctcccggaactccaaatgtaagtatcaaccacgtacaggtaactgtaacaccttttccaccttttccttttctccacagtggataattatgtcccaaaatcgctccaaatcctgtatataaaaaaatatcatgccatgttttatctggaaataacaggtgaccaagaataccggctacaataacttttaatatatcgccggctaataccaaaacaccttcctttttcccgatatgttccatgacatttgccatcccgggatttccagaccctattttacttacatcatttcctgtggaatgttttacaacgaacgttgcagttaacattgttccgtatagatatcccaaaatcaataatatacttttatatatcatacacatcttcctcttattttctattacagtataacataaaatcgattaatctcgaatagtaattatgttgttattttgcagatttttatgttcttctttgagctttttttgtgaaatgtttcacgtgaaacatttttattttttattctttttattataaacggaatcgcagcttaaatgcgtagattggaaatctttttatatcttcttttggattgatatacatagtgttacttaaaagacaatttttctatacgatgaataatactctgtttcttattaatttcaacgaaagaaagaagatattcagttctataagacgaaagaaaagatacattctctttctacacataataaaagaaactatagacaaagaaataatatttatagcacctgtctgtgaaaataggatgttaaacttgacagttatagctttcccagaaatatattaattaacgcttttttatttcctcctttctatggtacaatgataaaacacaattactggaagaaaatatgtttaataatatgataaaagggtcactaaggtatgcatcgaattgcatgcagcatgcgtcgataatatcttttgccccttttatcatataaagatgttcagaaaaatgtatttcatacaattgcaaaaacaccaaaagtaactatatatgatataggttttgacactgatactctcataacatatttgcacgtttgttacatattttcgaatcctataggttttgatatcggtactctcacaacgtgactatatctatatctatttataaggatatggattagatataatgatatgagagtcaaaaaacattttgcccctcatttaagattaatcagattactacatgctttgcattctcataatctgaccagatctcgaaatccgctaatttacatgcttgcatagtaaattgctactttctcaattgtggtgtggttcattacggtatccatcaaattgcatgcaaacatgcatcaatcataccttatgaccttttaatcacataatttcatggaaaaattttcaaggaaacgatactgataagtaccaaacatatctccggcacatcccctctggtacgcccatatcagaaagattttccaaaagaatcacaaaatcttggaaagaatgcagacacatttacagggtatataagatacgactattcagaagattagcgaaacccctgaaatatcagaagtatgattacattatagcaacctactctctgcaccatttgacagatagaaagataattatttttattccgaaacgatgataaaattgtcctcaccactgatctgatgataaacgaaacattattttattcagtaactgcttgatctcttaaataaaaatttaaaagatatgattagtgatgttactttaaaaatcgggatgaactggatatgtagggaaaagaaggtaataaatgggacaactatgaaatttatttttttaccgatgggcttaataagaaagtatttccaaaactttcattcatattatgctcttattgatccggtattttaaacatccgttcattaatttgtaaaaccggagcaaaatcatgcatatcataaattcaccgggcaaacttatatttaaactgctctccagcaaattctacttatgaaaataagaaaggataataaaatgtttcacgtgaaacattttattatccttttttaaacgaaactctctcgttttccattctttttacaattcaattaaattattgcgaatggcaaacactgcagcctgcgtccgatctgttacttctatcttcttaaaaatgttagatacatggttcttaacggttctctcactgatatttaacttttcagcaacttccttattatacattccaactgccaaaagtttcaaaacttccaattcacgctttgtgaggctctctatctttccttcatccctgttcttttcaatcatcttggaatttaatgctggaataagacttggctgaatataattttctccttctacgatggaaaatatagcttttttcaattctgcggattcagaatcttttaaaatatagccatccacccctatatcaaccgctttcatcagatattccacttcattatgtacggtaagaaccaaaacctttacctttgactttgaagatttaagcgtctgcaatacttccagaccattttttcttggcatattaatatcaagcaataatacatccggtgtacaaatttttaacttttccagacagtcaacaccatcttctgcttctgcaactacctgtatatctccttccaattccagtaaactttttaatccctctctgatcatggaatggtcatctgcgatcataattttaattgccatttttataagtcctccttcatttttggaattgacacaataatagaacatccctttccaggtgcagattctatagaaattgttcctgataacagatagaccctttctttcatcatagacaatccgaatccggaattatcatcccttgtctcatcgggaactgcatgaacatcaaatcccttaccgtcatctttaataactaacacaatcttcttttctaaataagaaacttttacctccagataagatgcctgtgcatgcttaactgcattattacatgcctcctgaatcacccgaagcaatgtaatctgaacaacactgttaatcggatatgatgtaccttccgtataatatccacattctattctatggaatctctgaaatcgatccaatgctctttcaaccgtaacgtcaaatccaatgtcatcaaaagacatgggtcttaaatcatagattaaccctctggtatcctcaattattttacggagtgtctgaccaatggaaaatagctctaatttacattttaccggatctgattctataatttttgagcataattccgttttatgtacaattgcagtcagattctgtgtggtagaatcatgtaattctcgcgctattctctgacgctctgtttcaacagaacgaagtaatgccagcctggtatcataagaatctatatccgcagcctcatgaatctttctttcaatctccgtttcttccttgataacgctggtaatatctgcaattcggaattcatattcctgcatctgatctctcagacacataatttcatttgatatccttttttgatctgcccgaagttcttccatcttttctttatgaaaagaattaaattctctcgggctgaacgcttcatatccgggatttgtttccttctctaaaacctgaagaaactttgtattctcttttactttattttcatatgaagaaatctgctcttccagagaaactttgtgttctatatactcctgacggattttttccagataatcttttaccatcttattcctcaaacgtatgttctgttttgtattttcaatatcaataatattataaatcattttacgggtaaagaaaataaagaaataaatattgtttgtaaaaagacccaaaaatgtctataatatatttaaaatcaaacaaattttaaatacaaggaggatttccatgaaaaaaggcacaaaaaaatttctttttttgagtgttgcaacactggcaggaatgtatgcatacaatcagtttgttgcctccacttccacaaaaaagaatatgctcccaaccaaaaacggatcctattattcctggaaacagggaaatgttttttacacaaaaactggaacaggagatcctgttcttcttattcatgacacaaattccgctagttcatctgttgagtggtcaaaaatttcaaaaagacttcaaaagaaacatacggtatataccatggatcttttgggctgcggtctctccgacaaaccagggctgagttataccaactatatgtatgtccagctgatcactgcttttatcaaagatattataaaatccaaaacatcagttgtagcttcaaacctctcctcctcatttgtaattatggcaaatcaactggatgcctccatcattgacaaaatgatttttattaatccggtttccttccattccatggatgccatgccggatcagcaaagtaaactaaagcaaacgatcataaatcttcctctggtcggaacctttatctataatttgctcatgaacccgaagcgtattgaccgtcagttccgttttacctattactgcagacctcagctgatttcttccaaaacgaaagatgcctactatgaagcagcccatatggacaacagtaatggaaaatacttatactcaagtcttcttggcaattatatgaatattgaccttcggcatgctgtgaaaaaaatcacaaaacctgtttcttttattaccagcagcgatataaaagcaaactacaaaacagcacaggaatatcgtaaactgaattctaacatagacatcacctatgtttccaattgcaaattgtatccacaactggagaatccggaaaaggtttaccaaattatcgaaaacaagttatccaattaattggaaatggactgtacctcaaagatacagtccattttttataactcatccataaatgtggataacatcttttttccgctcaaagcagtggaaaaaagcataaattacaaaggatttttggagggcattccggcttttcttggatatttttttgatgtaccgtttgcctttgttaaagaaatgaatgcccgctgcgcctctccaatagaaaacttatacacatcctcaacttttcctcctagaagaaaaatagctgattttgcagctgccacttcattttcacactctcccgatttataagaaataaactttccacccaaccggacgaatggaagacaatattctgcaagtgtggataaattggcaaccgcacgtgaaacacacagatcaaactgttctctatattcgggcatgcgtgccagatcttctgcgcggccatgaaccgtatagatctctgtcagtcctaacgcatcaatcacttcattcaaaaaaacaagtctcttatttaaagaatcagccagcaccacatttaattccggaaaaacaatttttaatgggattcccggaaaccccgcaccagttccaagatctataacttttaacggatgatgaagatccacaacctgtatcagagaaacactatctacaaaatgtttctcgacgacttcatcaaaatcggtaatggcagtcagattcatcaccttatttttttcgatgagcatttcataataagtcataaattgctgcaactgcttgtctgataatgaaatattcatttttgcaagcatagacagaaaatggtctgtattatattccatagaatcctccattatttttgtttttctttgtgttcatctgggtttaacttaaaaaataaatctggatttgaatattttaactgttccagatagaccagaagaacagagatatcggctggtgtgacacccgaaatacgtgatgcctgcccgatattcaacggctggaactcattcagcttctgttgtgcctcgattcgaagtcccgaaatttcattatagtcaaatttctccggaagttttttcttctccagctttttgaacttctctacctgcttaatctgtctgctgatatacccatcatatttgatcagaatattcacctgctctgttacctccgcaggtaaatccggccggtctgtatcaatttctgccagtttatcataatcaagctccggtctgcgaatcaaatcagaaagcgttgtaccggtatgaagtggaatacttccatattgctccagtacatgctgtactctcgcattcgccccgagcttaacttcattcacgcgctcaatttcctttttaatcagttcctcttttttgcaaacccagtcataccgttcctgtgaaatcagtccaatttcatatcccttttttgtcagccgcaaatccgcattgtcctgacgcaaaagtaaacgatattccgctcgtgaagtcatcatgcggtaaggttcgcggtttttctttgtgacaagatcgtcaatcaaaactccgatatatgcttccgaccggtcaagaatcagaggatctcttcccttaatttccattgcagcattgattccggcaatcaatccctgacaggcagcctcttcatatccggagcttccattaaactggccgccactgaacaaacctttcattgccttaaactcaagagacgcatacaaattgtttgcatcaatacagtcatactctatcgcatatgcatttcttacaattttaacatgttccagtcccggaagtgtccggtacatttcatgctgaacatcctccggcagagaagatgacattccgcccacatacatttcatttgtactaagtccttccggctcaataaaaatctgatgcctgtttttatctgcaaattttaccactttatcttcaatggacggacagtatctcggtcctgttccctcaatgattcccgcataaatcggagaacggtccagattgtttcggataatttcatgtgtcgtttcatttgtataggtcagccaacaggaagcctgctcgatctgcacatcctccggattcgttgtgaaagaaaacggaacgactctttcatctccaaactgctcttccatttttgaaaaatcaagactccttttatcgacacgcgccggtgttcctgttttaaatcttcttgtctggataccatgagcaaccagggaatctgtcagatggtttgcagctgataatccatttggtcccgtatgtgtaatcatttcaccggttaagcagcgcgctctcagataagttcccgtacaaagaacaactgccttacatctgtaaacacctccggaaactgtacgcactccggtaattttctgttcttctccctcatgatattcatcttctgggaaaaactgatctttatttgttaatatctctgcgacttccgcctgtcttatggataaatgatccgtattttgcagggtttttcgcatttcttttgtgtattccgctttatcagcctgtgcgcggagagaatgtacagccggtcctttcgatttattcagcattttcgactggataaatgttttatcaatatttttgcccatctctccaccaagtgcatcaatttcccgaaccagatgtcccttggaacttccaccaatgttcggattacatggcattagtgcaatactgtccacacttaccgtaaacatcattgtttccaatccgagtctggcacatgccaatgctgcctcacaacctgcatgcccggcaccgacaacaaccacatcatatgtttcttcaatataaggaatatttttcttactcatttttttacctgctactttcccatacaaaactttgaaaagatttcatccaccagatcatcctcgacagcttccccgataatcttacccagctcttcatacgcgcccatcagatcaatggaataaaaatcttccggcatgtcatcctcaatactttgtgttacctgatgtaaatgatcaagtgctacctgaagtgacgttttctgcctcatgttaattgcataaacttcatcattaaaagtaacttcaccctggaaaaacatattccggatcgtttcttccaattcatcaattccctgatgttctttcgcagaaatcggaataatctttttatccagaatatgctgtacctcttccactgtgacttttgtgtccagatctgatttgtttaataaaacaattgcttttttatcctgcaacagatccatgatctcataatcactttcatccagctctgtcgatgcatcaatcacatagattacgagatccgccttcgatgcatatgttctcgcccgatccacaccgattttctccactacatcttccgtatcccgaattcctgccgtatccatgacgtttaatgtaattccattcaggttaatctgctcttccaggacatctctggttgttcctgcaatttccgttacaattgcccgttcctctcccaccagaatattcaacagggaagacttacctgcattgggtttacccacaattacagtgttgataccttccttcagaaaacgcccattttcaaaggttttgaggattttatcaatttttataaccaagttatccacagtattgtgtaaagtttgtggataattatccagagaaatatgttcagggtcatccaaggcagattctataaaggcaatttcatgcaatatatctgcccggatctttcggatatccacaagaaccgccccctgcaactgggaaagtgaacttttcagtgcaaattcattttttgcgttgataacatcaataacggattctgcctgtgtcagatcaatccggccatttaaaaatgcccgtttcgtaaattcgccgggttctgccggccgtgccccatgtctgattacggtttccagaattcttttcataacatagacaccgccatgacagtcaatttccaccgtatcttcttttgtataagaatgtggcgccttcatgagtaaaaccatcacttcatccaccatctcgttatcgtcataaatatatccataatgaatggtatgactttcacataaactcaattttttatgaccatatttcgaacgataaatccggtcaataaccggcaacgcgtcttctccgctgatccggataatcccaattcccgaaggagacatcgcagtcgcaattgcagcaattgtatctgaattcataagtctctccaattctaaacaaaggtgaatacccaaaactggatattcaccttattttttaactctatcagtcagttccttatttctttaatgttacaactacatggcgatatggttcatccccttcactgtgtgttgtaacataacgatcattctgaagtgcagaatgaatgatccgtcgctcaaaaggattcattggttcaagagaaaccgggcgcttggtgcgctttaccttgtacgcaatattctttgcaagattctcaagtgtctcttttcttctctttctgtaatcttccgtatcaatcttaaccttataatattcatcggaatgtttgttgattgcaagatttgtcagatactgaagagaatccagcgtctgtcctctcttaccgatcagaattcccatatcatctccctttaactctacttcaatgatatgttcttcctcatttactgcaacgagaatttctacctccatcttcatcgcatcaaaaatggaagataaaaattcaacaacattctcatcaatggaaaatttcttacgagccttaattactgcatttttacttccgattccaagaaaaccggtacttcctttatcaagaacctcatactcaagctgatcactggttattcccagctgaacagtagcctgtgtaatcgcgtcatccacatttttagcagaaatctcaataaactccatataactgccccctcttatttacgattattcttttctctaaattcttttacaagatttgctttcgctgccatacttcccggctttgcatttgctttcgctgcatttgccttttcaagttccagttccctgtttgcagaagaaacatttgccttcgactggatggatctggtattcattgccgctgcctgacggatgcgttcctcagtaacgcccatcttctcccgtttctttttcaccttttcctgattctttgcaataatatcctcaagattaagattttcaatatgcttgttgataaagaactgctgaaccgcacggcacacggcactggcaatccagtaaataccgagaccaaccggtgtcacaaaacagaaaaacaaagacatcagaggcatcatggtattcatagttttcatctgtcttgccatctgatcattatccccacctgcggtagctgcggttggcatcaacttgatattgatcacctgtgtaatataagacaataccggaatcagaaccgccagaatcacaagcagccacgcatgaccttccatactgctttttataattgcccacggggtatccgaaatattaagccccagaaagtaattaaaatggttcatatcatgcattgtggaattaatctgatccgtaagtgacggaaactgctggaaaatactgccgtctaccgacttatcccacgctgtggatggaagcttgtacacaatatcggtaatataattggcaagatcctttcccgatgctccgtttaaagtatctgcaacattttttatattcagtccactggatgtaaccacattaaattttgtcattaaatccgaaacttttttcacaaacccatcggtattcataattccaccgaccagaccatgaaacgtctcgtttccggaaatcgtataaaaagaatcacgcacacttccgatatatgccggaatattataaaatacacgatataaagcaaacaaaatcggcatctggataagcatctggatacagcttccggatggagaaataccatatttctgatatacaagctgtgtctcctgattcattgccatcatggcttcctgatccttgcgattcttatatttatcacggatcgcattcagttccggctgcattttctgcgaaagtttcgagaatttctgctgctggattgtcaatggcaaaagacacatatagatcaaaatcgtcatgagaacgattgcaagcggtacactgttgatcgtaccaccggaaatttttaaaacaatatcgtaaattccgctcatgatccatccaagaacctttgcaatcggtccgaggaattttccggaatacgctgtcaattcaatcatgcctgacataaaaacctccatttggtttatggaaccgggtcatatcctcccttagaaaaaggattacatcgcaaaattctccaggcagccagtgccccaccctttatcgcaccatacttttgcacagcttccagtccataacaggaacaggtcggataatacggacatttcgttgacttcatgggagaaatatatctctgatagaatttaatacatgcaataagtaattttttcaatagaattccatcttcttttccatattaatgtattattttgtgaagacctccaagatgtttcagtgcgctcgaaatctgatgaaacgaagcatcacgcgctgttcctcttgcgatgactacaatgtccaaaccactattgaacatgtcctcctgtagccggtacccctctcggatcagacgggtcaaatgatgtcttataacactatttcctacttttttactaacggatatacctaatctgtttttgtctgtgtgattttccagaacatacataaccaataaacggtttgcatatgaatttcctttgttatacacattctgaaaatctttacttttctttaatgattctgagaacttcatctgaaaatatcctcataatagaagaaaagaccacaataatgtggcctaagctgataatttttttctaccttttaatcttctagcagccaatacttttcttccgcctgcagtactcattctgcttctgaaaccatgaactctggctctctgtcttttttttggttggaatgtcatcttcatttcgtatccacctcctctacgttaaaaaacatcacttagcattatatcagaaaaacgctacaagtcaagtaaaatcaaggttttttcctaatttaatgttataaacactacatataataaggaagaaaagcagtccactatatatagtatccacgcttttccacgaaataataagttatccacaatttggggataacttgtggataaactgtcaatacgccttggataactctttttccatcaacatccatataattaaaaaaccttcctaaaacgcattatttcgccgtttacgcatatgtttatatgttagttttgaaaaatataaaagggtgtctaaaaagttgattctacaccgaaaatggtgtattatagataagaataggattatgggatagtatcctattttataagaagaatgtggagaaaagcagatggataagattattgaaaagtgggatgaaattttaaatactgtaaaacaggagtacgaaatcagtgatgtctctttcgatacctggattcgtcccttagaagtctttgccattgaaggaaatactctctatatcctggttccttccgaacagatggctttaagctatatttccaagaagtaccttgcaccacttcgcgttgcgatcgtggaaattacagaaattgaatatgaaatcaaattcatccttccggaagaagccaggactctgaaattaaacacaaaaccagcaaaagctacacctgccgtaaccgcagatgaatctaatcttaatccaaattatacatttgatacatttgtcgttggtaataataaccgttttgcacattcggcttcccttgcagtcgcagaatctccgggagaagcatataatccgctttacatttacggcggtccgggactgggaaaaacccaccttatgcactccatcggacactttattttaaaccagaatccggatgccaaggttatctacgttacatccgaagaatttacgaatgaagtaattgaatccattcgaaacggtaatgcttcatccatgacaaaatttcgtgacaaataccggaaagtggatgtccttatgattgacgatatccagtttatcatcggaaaagaaagtacacaggaagagtttttccacacattcaacgcactccagacacagggaaaacagattatactgacatccgataaaccaccaaaagaaatggaaacccttgaagagcgtatccgttcccgttttgagtggggactgatggcagatatcggagtgccggattatgaaacacgtatggctattctccggaaaaaagccgaatcggataactttgacattgatgatgaagtattaagctacattgcaaacaacattaaatcaaacgtgcgtgaacttgaaggagcattaaataaacttcttgcttataacaatcttgtccacattccaattacaatggatattgcagaaaaggaactttccaacattatcacgccggacaagccacgggaaatcacaccacagctcattattgaagttgtttccgaacattatcacatctctgtagatcagatgatttcaaagacaagaagcagtgatgttgcaaaaccacgccagattgcaatgtatttatgtaaaaatatgaccgaaagtccactggataccataggttctttactcggcggacgcgatcattccacaattatccacggtatcaagaaagttaccgaagaatacgaaaaaaacgaaactacaagaaatatgatcgaaaccatcaaaaagaaaataaatccaaactaaatgagtttcttcctattataatgtagttttatttgcttttttttatttcaacttattcacgtttatccacagtggatggattgtgcatgaggttcttaacgtaaatctcttaaaatttgttccacagacggaccttaagaatcctcgcacttttcacatgctttcaagccggttatcaaacgccggaaaccgcttaacatctaacatgaagaggcttattcacatattaacagcccctattaagactaagacgaatgtcttaatatatttttatttataccaggagggagtttttcatgaaactgatctgttctaaatcaaatttattgcgcggagtaaatatcgtatccaaagctgttcctacccgtacaactatggcaatactcgaatgtattcttatcgatgcttctacgaatgaaattaaattaatggcaaacgatatggaacttggaatcgaaacccgtgtagaaggagaaattgctgaacgtggagttattgcactggatgcaaaaatcttttctgaaattgtacgcaaacttccagacagtgatgttatgattgaaacagatgcctcttttaagacggtgatctcctgtgaaaaagcaaaattcaatattgttggaaaatccggagatgatttttcatatcttccatacattgaaaaaaatgatgcaatcgtgatttcccagttcacactgaaggaagtgatcagacaaacaatcttttccattgctgataacgacaataacaaacttatgacaggtgaactgtttgaaattattgagaatgaactgaaagttgtttctcttgatggtcatcgtatctccattcgtaatatagaacttaaaaataattacgaaaataaaaaggttgtcgttcctggaaaaacattacaggaaatcagcaagattgttccaggtggagttgatgatgatgtactcatctacctgacggacaaccatatcgtttttgaatttgacactactacggttgtatcccgtctgatcgaaggagaatatttccgcattgatcagatgctctcatctgcttatgaaacgaaagttatagtcaataaaaaagaattacttgattgtattgatcgtgctactcttcttgtcaaagaaggtgacaaaaagccgatcattatgaatatcacagatggaagtatggagttaaaaatcaattctttcatcggttccatgaatgaagatatcgatatcgagaaagaaggaaaagacatcctgattggatttaatccaaaattcttcattgatgcattgcgtgttatcgatgaagaaaatgtaagtctttatatggtaaacccaaaagctccatgttttatcaaagatgatgaaggaaaattcatttatcttattcttcctgttaactttaataatgctgcaaattaggagattacatgattacagtaaatatccgtgaagaagacgaatttatcaaacttggacaggcgttgaaaaaagccggagttgttggttccggtgtggatgccaaaatggttattttagatgggcaggtttcggtaaacggtcagacagaacttcaacgaggaaaaaaattacataatggggatgttgttacctttcagggtgaaacaattcagatagttcaatgatcataaaatcaatcgagctgcgaaattttcgaaattatgaaaatctggatattcacctggatgaaggaaccaatattctttacggagacaatgcacaggggaaaaccaatattctcgaagctgcttatctgagtggtacaacaaaatcccacaaaggaagccgtgataaagagatgattcggtttggtgagaaagaatcacatattcgtactgtcgtacagaaaaaagaaaaagagtaccagattgatatgcatcttagaaaaagtggatcaaaaggcgtggctgtgaataagattccgatcaaaaaggcaagtgagttgtttggaatactcaatatcgttttcttttcgcccgaagatttaaatattataaaaaacggacctgcggagagaagaagatttattgatttagaactctgtcagttggataaactatatttgtcagatttatccagtttcaacaaagtgttgaatcagagaaacaaattgttgaaagatatttcttttcgcccggaccttgtggatactcttccggtgtgggatatgcagttactggagtatggaacaagaatcatccggaaacgaaaagaatttgtggaggaactgaatgaaattatttcagaaatccattcgagaatttccggtggcagggaacatctggtattaaagtatgagccaaatattacagctgatcttttttcggatgaattgctgcgggcacagaatcgggatttgaaactctgccagacaacggtagggccacacagagatgatatgctgttttccgttgataatgtggatatccgtaagtttggctctcagggacagcagcgtacttctgcactctctttgaaattatcggagattgatctggtcaggagatccattcatgatactccggtattgctgctggacgacgtgttatcggaacttgacagtaaccgacagaattacctgctgaacagtattgctaaaatacagactgtcattacatgtacagggttggaggaatttgtaaagaaccgtttttgtatcaacaagattttccaggtgataaacggaaatgtttatgaaaaggaatcagttgaagagatataaaggaaaggttcatccgttggatgaggaggaaattgatgagcgaattaacaaataataatcaggaatatggcgcagatcagattcagattcttgaaggactcgaagcggtcagaaagagacctggaatgtacatcggaagtacatctgcacgcggactgcatcatctggtctatgagattgttgataatgcggtagatgaagcacttgccggttattgtaaaaacattgaggtgaccatagaaaaagataattccataaccgttgaagatgatggacgtggaattcctgtcggaatgaatcacaaagccggtgtgtctgcactggaagttgtgtttactgttctgcatgcaggcggaaagtttggcggcggaggatacaaagtatccggaggactgcatggagtaggtgcttctgttgttaatgccctctccgcctggttaacggttgaagtatatcatgacggaaaagtgtatatgcaaagttacaagagaggaaaagcggatggaccggtagcggcagtccgggactgtgatccacaacttcacggtacaaaggttcattttctgccggatgcggaaatctttgaagaaaccgtatatgattacaacacgctcaaacagcgtttaagagaaactgcttttctgacaaaaggattatgcattacattaaaagacacgagggaagatagtctgcataatcataaattccattatgccggtggaatcaaggaatttgtggagtatttaaaccgcggaaaagaaccgttatatccggaagttatttactgtgagggaaatcgtgacggagtttacgtggaagttgcaatgcagcataatgattcttttaacgattccacgtttagttttgttaacaacatcattacgccggaaggtggaacacatcttgccggttttcgaaatgcgttgacaaagacgtttaattcgtatgcgcgggaagcaaaaattttaaaagacagcgatgcggcacttaccggagatgatatccgtgaaggattgacagcaattatcagtatcaaaattgaagagccacagtttgaaggacagaccaaacagaaactcggaaacagtgaggcacgtggtgctgtagattctgtggttacggaacagctgacgtattttctggagcagaatccggatgtggccaaaaatatctgtgaaaaatcgctgctggcccagcgtgccagggaggcagcccggaaagcacgtgatctgacaagaagaaagacagcacttgagggtactgcccttccgggaaaacttgcggattgttccgacaaaaatccaaaaaattgtgaaatctttatcgttgagggagattccgccggtggttctgcaaaaactgcaagaagccgtgcaacacaggcaattctcccgcttcgcggaaaaattttaaatgtggagaaggcaagactcgaccgtatttatgataatgccgagatcaaggcaatgatcacggcgttcggtaccggaattcatgaagattttgatatatccaagctgcgttataacaaaattattattatgacagatgccgatgtggacggtgcacatattgcaacactcatgctgacatttttgtatcgttttatgccggagcttattaagcagggacatgtttatcttgctaccccgccgctttacaaaattgagaaaaacaaaaatgtctggtatgcatacagtgatgaagaattaaacaatattcttgtggaaatcgggcgcgatcagaataataagatccagcgttacaaaggacttggtgagatggatgcggaacagttatgggaaaccaccatggatccggagcaccggattttaaaacaggttatgatggatgacgaaagttcatcggaaattgacgtaacattcacgactctgatgggtgataaagtagagccgagacgggaatttatagaagaaaatgccaagtatgtacagaatcttgatatttagggaggagcagatcagtggacgataaaatatttgaccaaattcaacaggttgacctgaagaaaacgatggaaacctcctacatcgactacgcgatgagcgttatcgcaagccgtgcgcttccggatgtcagggatggattaaagccggtacagcggcgtgtcctgtattccatgatcgaactgagtaatacaccggacaagccacatcgtaaatgtgcgcgtattgtcggggatacgatgggtaaataccatccgcacggggacagctccatttacggggcacttgtcaacatggcacagccatggtcgaccagatatccacttgtcgacggacatggtaactttggttctgtggatggagacggtgctgccgccatgcgatacacagaggcaaggctttcgaaaatttccatgcagatgattcgggacatcaacaaagataccgttgactttaccccgaactttgatgaaacagaaaaagaacctaccgtacttccggcgcgctacccgaaccttctggtaaacggaacgacaggtattgcggtcggtatggcaacaaatattcctcctcacaatctgcgggatgtcattcatgccgttgtgaaattaattgacaacgatattgaggagaaagagaccgacattgatgaattaatcaacatcatcaagggaccagattttccaaccggaggtgtgattttaggtactgccggtatcaatgaggcatacaggaccggccgtggtaaaatccgtgtacgtgctgtgacagatattgaaccgatggataacggaaaaaaccgtattgttgtaaccgaacttccgtatctggtcaacaaagccagactgattgaaaaaattgcagaactgcacaaagataaaagaattgatggaattacagatcttcgggacgagtctgaccgcgaaggcatgcgcattgttattgagcttcgaagagatgtaaatccaagtgttgttttgaatttattatataaacacacacagatgcaggatacatttggcgttatcaaccttgcgcttgtggataaccagccaaaaattctgaatttatatgaattacttaactattatctcattcaccagaaagaggttatcacaagacgtaccagatttgacctgaacaaggcggaagaacgtgcgcatattttacagggattgatcattgcattagacaacattgatgaagtgatttccattattcgcggaagccgtacaactgcagacgcaaagaattccctgatggagcggtttggattatccgatgcacaggcacaggcaattgttgatatgcgtctgaagaccctgaccggtttggaacgggagaaactcgaaaacgagtataaagacctcatggcacagatcacggaacttaaggcaattcttgcagatgagaaaaaacttcttgcagttatccgcacagaaattctggaaattgcagataaatatggcgatgacagaagaacccagatcggatacgatgagtttgatatttccatggaagatctgattccggaaaccaatacggttattaccatgacaaaggttggctatatcaagcgcatgggaaccgacaatttcaagagtcagcaccgtggcggtaagggaattaagggaatggagaccattcaggatgattatatcgtggaaatgcttatgacaacctcccaccattacctgatgttctttaccaatatgggacgtgtgtaccggattaaggcatatgaaattccggaagccagccggacttcccgaggaaccgcaattatcaatatcattccgttacagccggatgaaaagattaccgcaatgatcccgatcaaagattatgagaaggataaatatctgtttatggcaaccaaaaacggaatagtgaaaaaaacttccgtgctggactatgaaaatatccggaaaacaggattggcagcgatcagtctgcgtgatgatgatgaattgatcgaagtaaaaattaccggggatgatgaagaaattctgttatttacccggtatggacagtgtatccggtttaaagaagccgatgtccgtgcaaccggtcgtacgacaatgggagtcattggaatgaaccttactgccggagatgaagtaattgccatgcagatggcttcccagggagagtccgtcatgatcgtatcggagaacggtcttggaaaatgtacacggatcaatgagtttacaacacagaaccgtggtggaaaaggtgtaaaatgctataaaatcacagaaaaatctggaaatctgatcggagtgaagtctgtcgtaaaagatgatgaactgatgttgattacaacagaaggaatcatcattcgaattcgcgtaaatgatacggcattactgggacgtgtaacctctggtgtaaaactgattgatctcaaaagtggtgtgacggttgcaagcattgcaagagtcgtagaagataaatcactgatgccaccggaagaggaagcaacagaagaaaatgagacggaaggtgatccatcatgattcggaccatacagacagaagaaatcacaagaaatataaaagaaatgtgcattgaagcgaatcattttcttgcggaagatatggaacatgccatgaaaaaggctgcagaagaagaaaaatccgaacttggaaaaaaaattcttctgcagctgcaggaaaatcttaaaattgcgggagaagaaatgattcctatctgtcaggataccggaatggctgtattttttgtagaaatcggtcaggacgtgcattttgaagggcaatggctggaagatgcaatcaatgaaggtgtgcgccagggttatacggaagggtatctccgtaaatccgttgtagcggacccgattcttcgtgaaaacacgaaagataatacaccggcaattatccactattcgattgttcccggagataaggtgacgattacatttgctccgaagggatttggaagtgaaaatatgagccgtattttcatgttaaaacctgcggatggaatagacggagtaaaaaatgcgattcttactgccgtaaaagatgcaggaccaaacgcgtgtcctccaatggtagttggtgttggagtcggcggaacatttgaaaaatgtgcaattctggccaaaaaagcactgacaaggccggtaaatgaacattctaagattccttatgttgcagatctggaaaaagaaatgctggtaaaaatcaataagcttggtattggaccgggaggattaggtggaaccactactgcccttgctgttaatataaatacttatccgacacatattgcagggcttcctgtggcagttaatatctgttgccatgtaaatcgtcatgcagtcagaacgatataaggaggaacaggtatggatcagcatattacaacacccatcacagaagaagtgacaaaaaaacttcattccggggattatgtatacatcacagggacaatctatgtagcaagggatgccgcacataagaggatgatagaagcattggatcggggagagcaattaccgattgatatcaaagatgcaacaatatattatatgggtccttctcctgcccgtgaaggacgtccgattggatctgcgggaccaactacagccactcgtatggataagtatgcccctaccctgcttgatcttggtgaaaaagcaatgattggcaagggaaagagatcaaaagaggttatagacgctattatccgcaatcatgcagtctattttgcagcagtaggtggagcaggtgctctgctctcaaagtgtatcagaaaatccgagattgtatgttatgaagatcttggtgcagaagcaatccgaaagttatatgtagagaattttccggccattgtagtaatcgatcaggatggaaataatctatatgagacgtcaattaagaaatttgcatcagaaatataataaaaattaaaaaagaggttgacaaaaaggactgtttttagtagaataaacaatgcgtcacgtaaggacgtaattttatatagaaagtatctggagaagtactcaagtggccgaagaggtgcccctgctaagggtataggtcgggttgaccggcgcgagggttcaaatccctccttctccgctctatattttctaaataaaatgaaaaaagttgttgacaaacaatgacaaacatgataagatatcagagttgtcgcgtttgagagacaacaaagaaaaataaaaaagttgttgacaacgacttgaagatatgataaaatatacaagctgttggaaataacaacaacgaacattgataactgaacagtgaaaaaccttgaaagattttgagaataattcaagaacgcttctgtaaagaagcaaccttaaaacagtaaatcaggacattgtttctgattaaaagccagatttaattctggcaggacaaaactttttaacatgagagtttgatcctggctcaggatgaacgctggcggcgtgcttaacacatgcaagtcgaacgaagcactctatttgattttcttcggaaatgaagattttgtgactgagtggcggacgggtgagtaacgcgtgggtaacctgcctcatacagggggataacagttggaaacgactgctaataccgcataagcgcacaggatcgcatgatccggtgtgaaaaactccggtggtatgagatggacccgcgtctgattagccagttggcagggtaacggcctaccaaagcgacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaagaatgacggtacctgactaagaagcaccggctaaatacgtgccagcagccgcggtaatacgtatggtgcaagcgttatccggatttactgggtgtaaagggagcgcaggcggtgcggcaagtctgatgtgaaagcccggggctcaaccccggtactgcattggaaactgtcgtactagagtgtcggaggggtaagtggaattcctagtgtagcggtgaaatgcgtagatattaggaggaacaccagtggcgaaggcggcttactggacgataactgacgctgaggctcgaaagcgtggggagcaaacaggattagataccctggtagtccacgccgtaaacgatgaatactaggtgtcggggagcattgctcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccgatgacaagctatgtaatgtagcctctcttcggagcatcggtgacaggtggtgcatggttgtcgtcagctcgtgtcgtgagatgttgggttaagtcccgcaacgagcgcaacccctgttcttagtagccagcggtccggccgggcactctagggagactgccagggataacctggaggaaggcggggatgacgtcaaatcatcatgccccttatgacttgggctacacacgtgctacaatggcgtaaacaaagggaagcaaagccgtgaggccgagcaaatctcaaaaataacgtctcagttcggactgtagtctgcaacccgactacacgaagctggaatcgctagtaatcgcagatcagaatgctgcggtgaatacgttcccgggtcttgtacacaccgcccgtcacaccatgggagttggaaatgcccgaagtcagtgacccaaccgcaaggagggagctgccgaaggcaggttcgataactggggtgaagtcgtaacaaggtagccgtatcggaaggtgcggctggatcacctcctttctaaggaaatcaagtagagatttttcactgttgagttattgatgtaaaagttaataacatatttctggtggcgatgcgcttaggggaaacacccgtccacatcccgaacacgatggttaagacttaagcggccgatgatactatactggtaacggtatgggaaagtaggtggctgccagatcgaaaagaataagcaaagcattgcttttcaaaatagaacagctcttgcgtagcgagagtaacctacatcagcagggaagtgctgttcagatagctggttttaccagtgattagagattttaaataattaagatttctaatgactgataaaaacttcagtcaaaacattgtactttgaaaacttcatacagaatgataagatgattaaatatctatttgatcaagacatcgtaataaccgtaaagttctttaatgaataataagtaactgaccagaagttggttacgaaagttatcaacgctatgataacgaggattgaataatcaagcaaaaaagagcgcagggtggatgccttggcactaagagccgaagaaagacgtgataagctgcgaaaagctgcggggagatgcaaataatctttgatccgcagatgtctgaatggggaaacccggctggaaggactccagtcatccatacgccaatccataacgtatggaagggaacccggtgaactgaaacatctaagtagccggaggaagagaaagaaacatcgatttccagagtagcggcgagcgaaatggaaagaggccaaaccgttgtgcgtgcacagcggggttcggaccgcataattgattcagtgattctagcagaaaggttttgggaaagcctgccggagagggtgaaagccccgtaagcgaaaggaaaactgacaaggcggtatccagagtacatcgagacacgtgaaaccttgatggaacacgcggggaccaccccgtaagcctaaatactacttagtgaccgatagcgcatagtactgtgaaggaaaggtgaaaaggaccccgggaggggagtgaaagagaacctgaaaccctgtgtttacaatctgtggaagatctttatatgatcaaccgcgtactttttgtagaacggtccggcgagttacgcgtactggcaaggttaagtgcttaaggcacggagccgaagcgacagcgagtcttaactgggcgatgagtcagtacgagtagacccgaaaccgggtgatctatccatgtccaggatgaagatgccgtaaaaggcattggaggtccgaagccacatccgttgaaaagggtgggcatgaggtgtggataggggagaaattccaatcgaacccggagatagctggttctcctcgaaatagctttagggctagcctcgttttagtcttatggaggtagagcactgaatttccgcgggggcgtcaaagcttaccaaagaatatcaaactccgaatgccatgtagatgatgaacgggagtcagactgcacgagataagttgggcggtcaaaagggaaagagcccagaccaccggctaaggtcccaaagtgtgtgttaagtggaaaaggatgtgggaattcgaagacaactaggatgttggctcagaagcagccatacattcaaagagtgcgtaacagctcactagtcgagagtccctgcgccgaaaatgtccggggctgaaacacaacaccgaagccgtggactccgtaaggagtggtagaggagcattcttaaaaccgacgaagctgtaccgataaggagcagtggagggataagaagagagaatgccggaatgagtagcgagaggaaggtgggaatccttccggccgaatatctaaggtttccagagtaaagctgatctgctctgggtaagtcggggcctaaggagaggtcgcaagacgtatccgatggacaacaggtttagattcctgtaccgcatataaacagaactgtggggacgcatgtggaaagcataagccgggaatggaaagaccggtacaagcgaggtaggtgtgtgacaggcaaatccgtcacataagccgaagacgtgatgtggagcgaaatttagtagtgaagtatgtgagccatgtgccgagaaaagccgctattgttttatatgtgcccgtaccgtaaaccgacacaggtggatgaggagagaatcctaaggccgacggaagaagcattgttaaggaattcggcaaaatgaccccgtaacttcgggagaaggggtgcccactgaatggtgggccgcagagaataggctcaagcaactgtttagcaaaaacacaggtctatgcgaaaccgaaaggtgaagtatatgggctgacgcctgcccggtgctggaaggttaagaggagaggttagcgcaagcgaagctttgaatttaagccccagtaaacggcggccgtaactataacggtcctaaggtagcgaaattccttgtcgggtaagttccgacccgcacgaaaggcgtaatgatttgagcactgtctcgacaatgcatccggtgaaattgaagtaccagtgaagatgctggttacccgcgccaggacggaaagaccccatggagctttactccagtttgatactgggattcggtactgcacgtacaggataggtgggagactgagaactatggacgccagtctgtagggagtcgctgttgggataccacccctgtagtactgggtttctaaccatctgccgtgatccggcagtgggacaatgtcaggcggggagtttgactggggcggtcgcctccgaaagggtatcggaggcgctcaaaggttccctcagaatggtcggaaaccatttgaagagtgcaaaggcagaagggagcttgactgcgacaccgacgggtggagcaggtacgaaagtaggacttagtgatccggtggtataaagtgggattgccatcgctcaacggataaaagctaccctggggataacaggcttatcactcccaagagttcacatcgacggagtggtttggcacctcgatgtcggctcatcgcatcctggggctgtagcaggtcccaagggttgggctgttcgcccattaaagcggtacgcgagctgggttcagaacgtcgtgagacagttcggtccctatccggcgcgggcggaggatatttgagaggagctgtccttagtacgagaggaccgggatggacggaccactggtgtatctgttgtcgaccaacggcatggcagagtagccaagtctggaagggataaacgctgaaggcatctaagcgtgaagcccccctcaagatgagatatccctccttcgggagtaagaccccttgaagactacaaggtagatagggcagaggtggaagtgtggcaacacatggagctgactgttactaataggtcgagggcttgattaaaaaagctgttaaatctgtatgaagttttgaaagtatatactttcaattgataatcctcgatagctcaatggtagagcactcggctgttaaccgagttgttgtaggttcgagccctactcggggagttttggtgacttagccaagtggtaaggcgtgggactgcaactccctgatcgtcggttcaaatccgtcagtcaccttttataaacacgatgagacttctcatcgtgtttttttaataaaattatgtctaatataaagacattttggcttatctggtaaattaagatagagaacaatatttctaacattcacagcaagaaatccatagacatttgcttccaaactccgtatgctgaaagtagaatacaggaattacggaggaggaagcaatatgcagcaaagaggaagagtcactattccgactgatgtagatgtcgtgccggagacacttacactgatggagcgctggggggccgatgccatccgcgactgcgatggtacggattacccagaggaactgcgcgctgtggatgccaaggtctattcgacctattacaccacaagaaaagacaatacatgggcaaaggcacatccggaggagatacagcagatgtatattatgacgccgttttatacggcggtcgacggagatttacagatccatctcatgacgcatctgtacccggatatgttaaaagtcaacaaccgtgatgacattacgcgttggtgggaagttatcgaccgcacgacgggggcggttgtttcaaccagccagtggtcgtatgatgagacaactggcgacgtgacgatccacaagccggaggcgttccacagttacacggtcagttttctggcatacattatgtgggacccggtgcatatgtataatgccgtgaccaacggctggaaagatgtggaaaagcagattacgtttgatgtgcgccagccaaagacccacacctactccatggagcggctgcgcagatttatcgcggagcatccgtatgtggatgtcatccgctacacgaccttttttcaccaatttacgctcatctttgacgagttggcgcgggaaaaatatgtggattggtatggctattccgcatcggtcagcccgtatatcttagagcagtttgaaaaggaagtgggctatcggttccgcccggagtttattatcgaccagggctatatgaacaatacttaccgcgtgccgtccaaagaatttcaggattttcaggcatttcagcgcagggaagtggcaaagcttgcaaaggagatggtggatatcacacatgcgtgcggaaaagaggcgatgatgttcctcggtgaccactggatcggtatggagccgtttatggaggagttccagacgatcgggctggatgctgtggtcggaagcgtcggaaacggtgcaacgctgcgtctcattagtgacattgagggggtcagatacactgaggggcggttcctgccgtactttttcccggataccttccacgagggaggcgatccgacacgcgaggcgaaagtcaactgggtgacggcgcgccgggcgattctgcgcaaaccgatcgatcggatcggctatggtgggtacttaaaacttgccacacagtttccggattttatcgactatgtggagagcgtgtgcaaagagttccgcgaactgtacgaaaatattaagggaacgaccccgtactgcgtcaagcgcgtggcaatattaaactgctggggaaaaatgcgcgcgtggggcaaccatatggtccaccatgccatttactacaagcagaattattcttatgcgggcatcatcgaggcactcagcggtgctccgtttgacgtgaaatttatcagctttgatgatataaggaatcatccggatctgctcgattcctttgatgttgtcttaaatgtgggcgatgcctacaccgcttataccggcggggacaattggaaggatgaggcgattctgaccgcagtccgccggtttgtctaccggggtggcggtttcatcggcgtgggcgaaccggcatcctgccaatggcaggggcacttcttccagcttgcggacatccttggcgtggaagaagaaaccggctacacgttgaatgtggacaagtataactggcaagatcatgcgcattttatcacggaggacagcggcgatgcgattgattttggcgagggcaagaaaaacatattcgcgctcgaatccgcgaccgtgctacgccagatcgacaaaggtgtacagcttgccgtgaatacgttcgggcagggcaggggtgtgtatatcagtggcctgccgtacagctttgcaaacagccgcctgctgtaccgggcgattctgtgggcggcttcggcggaggggaaaattcaccgctggttttccacaaattacaatgtcgaagtgcatgcttatgtaaaaaacggcaaatactgtgtcgtcaacaacacgtatgaaccgcagcagacgaccgtttaccggggggacggcagcagttttgcggtcgaccttgcggccaatgcgatcctctggtacgagatctaggaaagaaactgtctgcggtaggcatcgggggagagcgtggtttcccgacggaatgcctgcgaaaaatacgactgggaagaaaagccgaccgcctgggcaatttttgcgaccggaaagtcggtgtgttctaacagggatttcgcctcttcaatgcgtctggtaatcagataattgatgggcgagattcctttgtatttggtgaaggcgtgggcaatgtaatatttgctgtggaatgttaaggcacttagtgtatctaacgtgattgtttccgcgtagtgcgcattgatgtactgctcgatcatgcggcattcctgtgaggttttgccgacggagacggcctccggcgtgacgcggatctcccgccggatcagatagagcagattttcgagcagattctgtgacatttctacataattttctttgcggtcatgcagttcctgtatgagcgatctggtataaaacagacaggcagggcggattgtctttacatttttgcagaggcaggttatgggcgcgtgtccgtcggtttcaaacgctatgccctcaaatccgagaacaacatattccaaagccgcatcgccgttgctgaattctgtgtgcatgacatggggattgatgaggatcaggtcatctgccgcaatgcagaaggtttgtgtctcggtctggaatgtgccggttccgtttaagacataaaacagctcggtaaacgggtgggagtgcagcacgctcggccaggtcttgtcgtagctggaatggctgatataaagcaggcgcagatccggccgtttcttttgcgcgtcaaaggtttgtggtttgaagttgtactgctggtatggcataggcatcccctcctgaaaatagcatgtgcatttgcacctgaaatctgttatagtaattatagcgcaagatttataacaatgtaaacaagatcccgatagcggagcggcagcacgcgccttatcatgaagtggtaacagacacaacacataagggggaaaacaatatgagagcgattacagaacagcagaaacaggaagccattgcagcatttgcatacgagggaacactgattgcagatacggtgtacgggagcggacatatcaacgacacgttccgcctgacgtttgcagtcggcaatatgggggatctggatgtgatcttacagcggatgaatgccgatgcctttccacatccggaacaactcatggaaaacattgcgggtgtgacggggttcttaaaaaagaagattattgcgcggggcggcgacccggagagggagacgttaaatatcatcccgaccgtggacaacaaaccgtactaccgtgacacaaacggggactactggcggtcgtaccggtttatcaccggggcgagcagctttgatcaggtggaaacgccgcagcagttttatgagagcgcggtcgcattcggcagcttccagcggcttttggcggattatccggcagagacactccatgagacaattccggggttccacgacacgcgggcgcggtttgcggcatttgaaaaagccgtccgggaggatgttgtggggcgggccgcggaggttcaaaaggagatcgcttttttcttagagcggaaggagacggcctgctattttgccgggcggcttgaccgcggggagcttccgatccgcgtgacgcacaacgacacgaaattaaacaatgtcatgctcgacgataagaccggaaagggggtctgtgtcattgatcttgatacggtcatgccggggcttgccatgaatgattttggcgatgcgatccgctacggggcgagcactgcggcggaggatgagcgggatctctccgaagtctcgtgcagcatggagctgttttccctctttaccaaaggatttctggagggctgcggcggcagcctgactccggaggagaccgcgctgcttccgatgggggcaaaggtcatgacgtatgagtgcggcatgcggtttcttatggattatttacagggcgatcgttatttcaagatccaccgggacggacagaatctcgaccgtgcccgcacgcagcttacgcttgtggcagacatggagcgcaagatgcagcagatgcaggacattgtaagaaaggcagcagggtaatggcagaaaagaaaaagaagaagatggagtttaggtactaccagttaccgcccggaagtccgattcttgcacttctgggagaaaagtgggtgcagaattatggtgaccgcacggcagacaggcttcatttccacaattacatggaacttggctattgttattacggggcaggcgacgtggtactgggggatgacacctaccgtttttcggggcagcagtttaccgtcatcccgtcgaattttccgcacacgacaaacagcgatccgggcaacatcagtcgctgggaatatctgtttgtcgatgtggaggtggtacttgacggtattttcccggacaatgcactccgcaaagagcgcgcactgcagcggctctatgaaaagccgtggtttttggaggaagcagagtatccgaaggaagcggcaaaaattaaagaaatcttaaacatcatgcgaaaaggcgatgaattttatcttgaggaggcaaaggcactgctgggctgtcttcttttggagatcacacggttaaactacacgaacaaagagacgcgcgcggatgccgagcagggcaggatcacctgcatcgtctcccgcgccatggactatatctccgatcactacatggaaccaataagggtagaacaactggcgaagtacagccatctgagcgagacacatttccggcgtgtgtttaccgaatatatgcatatggggccgcttgaatatatcaacacggtgcgcatccgcacggcgtgcgagcacttaaaaaagaccgaggaaccggtggcggacatcgcccacaaatgcggatttacgaccaactccacgttcaaccgcaatttcaagcagatgatgggggtcacacccgtggagtggaggaagcgtccggaaaattacgaacagcggctgctcaattatgagatccacacagagaaaggatggtaacaaccgatgcagggggcaaaactgatacaacaggtaaagaggaaacaaaagaagatgacgggggttctgcggaagctcatggtcgtattcggggtattttttgtgctgcttgggatcatgatctcacaggcatttatgttagcgggctttcttctggtggcactgtattttgtatttgatgtgttaagccggaaagagtacgagtacatcctcgacgggaaaacactcacaattgatgtgatctatgggaagcggtaccgtaaaacggcacacatcattgacatgaccgagatggaagtgaccgcgccaaaccgccacgaggctgtggcaaagtaccgcaaagacgggggcggggtccgactgccgaagtttgattatacctcctatgaggatgacattccatactacacgatgatcgtcattgaggaccgggaaaagaaaaaattgttgcttgatctcaatcaggaactgctgtttgcactcaaaaaacagtatccttctaaggtttttgcataaagtggtgaataaaatatgaacagttgcaaacaaatcatgaacaacaaatgtgcgcaaaatcagagaatccatcatttcaacgaaaaattgcaggaatgcaagcggttgtaatggtggatttgttgcatcacatggcacgcataatggcaatatgaatggaaataaccgaaaatatgcgaaaaaatagtgcaaagcacacaaaatgattgaaattgcacattatacggacaattatgcaaactagatatattcaagcaatgctataatacgttcatcagcaaaagtaacaaatactcttagggagaaggaggaaatttatatgaaaaagaaaatgattacagcattacttgcaagtgcaatggtattgtcactggttgcttgcggtggaggcggaacagacagcaacggtggcggggatacatcctccagcggaagcggtacttcttcctcatccgacagtaataagctgaccgtatgggcatgggaccagaactttaacatcaaggcaatagagaccgcagccgagcagtacaagaaagaccatccggattttgaactcgaagtggttgagacctcttctgatgactgccagaccaagctgacaaccgcagcaaatgccggtgattacagcacactgccggatatcgtactcatgcaggacaacagctaccagaaattcttaaaaagttatccggatgcctttaccgacctgacggatatgggaatcaactgggatgatttcggaaaattaaaacagtcttactctatggtagacgacaagcactacggtgttccgtttgataacggtgctgttatcgcatgttaccgtaccgacatcttaaaagaagccggatacaccatcgacgacctgaccgatattacctggagcgaatttgcaaagatcggaaaagatgttcatgataagaccggcaaatacttactgaccagtgagggaactggcggagacactatgatgatgatgatccagtcctgcggtgcaaactttgtcaatgaaaacggagatgcttacattgtaggaaatgacatcgctgagaagtgtgtcgacatctacaccgaactcgtacagaatgatgttgtaaaattagtaaacaactgggatgagtatgtatccaccatcacaaatggtgaggcagcaggcgttgtcaatggtaactggatcactgcaacgatcgcttctaccgaagaccagaaaggccagtgggcaatcaccacaatgccaagtgtagatggtgtggattccgctactcattatgcaaacaacggtggatcttcctggtatgttaccgcaaactgccagaacaaagatcttgcagaagatttcttaaagagcacttttggttccagtacagatttctatgatgcaatccttccacagaccggtgcgattgcctgctacttaccagccggagaatcggatgtatacaacgagccaaacgagttcttcaacgatcagccgatttactccacgatcgtagaatactcttcccatattccggagtttacaaagactccgtatcactatgaggcaagagagtgcatcaacacagcagttgtcaatatcgtaaatggaacagctaaggctgatgcattacaggaagcacaagataccttacagtttaagatgacggagtaatccggtacataaaaaagaatgacaagtttgtatagcggggggcgacctccgctatatgtgaaaatgaccagaaatgcgaaagggggaatttgttgtgaattccaagaaaaaagggatgtcacttattgcaaaacaaagagcggcaggatggacatttctagcaccggcatcgattctgattgcgatcatgagtttttatccgatggtgcgggcatttatcatttccctgcaaaagggaacgggtgccaatatgcgctttactggattttccaattatcagagaatccttgttgataaggtgttccagcagtccatcggcaacacatttttctacctgattatccaggtgccaatcatgcttatacttgcaattctgctggcacagttattaaacaacaaacatttaaaattgcggggattgttccgaacctgtgtcttcctcccatgtgcgacttcactggtttcctattcgttgatcttccgttcgatgtttgcaacagacggactgattaacagtatcctcatgaaacttggtatcttacattccggctataatttcctgggtcattccggaagtgccaaagcggtcattatccttgctttgatttggagatggactggttataacatggttttttatctggctggtttacagaatatcgagtattccgtatacgaagccgccaagatcgacggtgcaaacggctggaaaacattctggaggatcaccgtaccgctgttaaaaccgacgatcatcatgacctttatcatgtcaatcaatggtacgttgcagttgttcgatgagtccgtcaacctgacaaagggtggacctgccaatacgactattaccatgtcacactatgtatacaacacatgttttatcaatgtgccaaactttggatatgcggcagccatgtcatttttgatctttatcatggtagcgatccttgcatttatcaacttgaaagtaggtgatacgcgtgactaagcagaaaagcaaatcaatgatccagagaagattgatcccgacgtatatctttctggggatcgtgtcctttatttccgtattcccgctgtattggatgatttccgcagccacgaatacatccacggacgtatcccgtggtcgcctgcttccgggtacgcactttatggagaactttaagaacttaatgtcccagcagccactgtggagagccctcgggaattcgttcctgtatgcgatccttacgacggtgctgtgtctcttggtctgctccatcgccggttatggttttgagatctaccatgacaaatggaaagaccgcctgttttccatcctgcttcttgccatgatgataccacaggttgcaacaatggttccgttgtttcagatgttttccaaggcaaagctgttaaatacagcggttggatttatgcttccgatcatatccacaccgtttatgatcatgatgttccgccagaatgcccgtgcatttccggttgacatcatcgaagctgcgcgtattgatggattaagcgaggtacagattttcttccggatgtttatcccgacgatgaaatcgacctatgcggcagccgctgttatcacattcatgaatgcatggaatgcatacttatggccaaaggtaatcatgtccgataaccgtgcgatgactatgccaatgctcattgccaacctgattaccggatacaagacggattacggtatgctcatgtgtggtgtattgttctgctcaatcccgacgatgatcgtattcttcgtattacagaagcagtttgcagaaggtatcaccggagcggttaaataaaaatggtaaaaaatgccttcctttttggagggcattttttaccataacaggaaaggggtatatgcctatgaatacatttgattataagaaagtaaaagatcctcagtattttcgtgatgcgcgcatggatgcgcattctgaccacatatattaccggacgaaagaggaggcagaagagaaacagagttcctaccgcgtcagtttaaacgggctgtggaagttccactatgcaaaaaactatgccgacgtagttgccggatttgagaaggaagactactgctgtgtaggttgggatgacatcaaggttccggctcatatccagatggagggttacgatgtgccgcagtacgctaacgtgcagtatccgtgggaaggccatgaggacatccatccgggcgagatcccggagcagtttaacccggtggcaagctatgtcaaatattttaccgtgccgaagcagatgcaggggaagcggctctttgtctcgtttcagggcgcggagagcggacttgcagtctggttaaacggcacattcatcggttacagcgaggattcgtttactccgtctgagtttgaactgaccgatgcggtaaaagacggggaaaacaaactggcggtacaggtgtttaagtggacagcgagcagctggtgcgaggatcaggatttcttccggttttccggaatctaccgcgatgtatacctgtatactgtgccggaagtacatgcctatgatgtaaaggtgcgggcactgccggatgcagcacttaccgctgccgaactggcactgactttacagatgtggggaagcggcaaggtgaaagtcgtcctcaaaaaagacggacagactgtgctggaagacgaatcggctgttaccgaaggggaacagatcctgacctggaacgtggagcggcctgttttgtggagcgcggaagacccgcagctttatgaccttacggttgaagtctgcgatggcgcgggaactttacaggaagtgatcccgcagcgcgtcgggttccgccggtttgagatgaaggacggtattatgacattaaacggaaggcggatcgtctttaagggcgtgaaccgccacgagttcagttccgtcagcggacggcatgtgtcggaggaagagctgcgcaaggatcttcgcacgatgaagcagaataacatcaacgcgatccgtacctgccattacccggatgcgtctaagatttatgagctctgtgatgagtatggcatttacatgattgatgagacaaatctggaatcgcacggttcctgggatgtggcagagtttacgaaggacgatacctatatcgtgccgcacaacaaaccggagtggcttgcgatgatgcttgaccgtgccaattcgatgtaccaacgtgacaaaaaccatccggcgatcctgatctggtcgtgtggcaatgagtcttacggcggcaaggacatctatgaaatgtcctgtctgttccaccgtctggatgatacccgtctcgttcattacgaggggctgttccacgacagaagttacaacgatacgagtgatatggaaagtcagatgtacccatcggtggagagcatcaaagaatttttggcaaaggattcgagcaagccgtttatctgctgcgagtacacgcatgcaatgggcaattcctgtggtgcgatgcacaaatatacggatctgaccgacacggaaccgaagtatcagggcggctttatttgggattacatcgatcagtcgatctacaaaaaagaccgctacggcgaggagtttcaagcatacggcggggattttggcgaacgtccaaccgactataactttagtggaaacggtattgtctacggtggaaaccgcgatgtgtcaccaaaaatgcaggaagtcaaattcaattaccagaacatcacggcggaagtgactgcggagtccgtaacggtcaaaaataaaaacctgtttgtcaacaccgaccgctttgcgtgtgttgtgaccgttgcaaaagacggaaaggagatccgccgggcagacttaccgacggctgtggagccgctctcggaacagacctatccactgccgtttgcaaaagagacaaaggcaggcgaatacaccgtgaccgtctccttccatctgaaagcggacactgtctgggcaaaggcagggcatgaggtggctttcgggcagtatgtctatccggttgcgggtgaggcagaaacatgcacagacaagatcaaagtgatccacagcacacacaacatcggtgtagagggtgcgcatttttccgtcctgttttccgtattaaacggtgggctggtttcctacaaatatgcgggaaaagagatgatcgaggcgatcccgaaaccaaacttctggcgggcaccgacggacaatgactgtggaaatctcatgccggcgcgctatgcacagtggaaaacggccagtctgtatgtcagccataaaagcccgcaggagacgagtacgccggaagtcacggaacacgaacacagcattaccgtttcgttccgctattttatgccgaccacaccggtttcggaatgtcggttgtcctatgaagtatttggggatggcagggtaaagaccacgctctgttatgatccggtcaaagaattgggcgacatgccggaatttggcgtactgtttaaatttaatgccgattacgaccgactgcagtggtatggactgggcgaacaggaaacctatgctgaccgttgtaagggagccaaacttggcatctacagcaataaggtaaaagacaatgtggcgcggtatatggttccgcaggaatgtggggcaaaatgtggcgtgcgctgggcgcgtgtgactaaccgtgccggagatggcatgttgtttgaaatgacagaagaaacaggtccgatggtattttccgcactgccgtatacgccgcatgagatagaaaatgcgatgcatccgtatgagctgccaccggtacactacacggttgtccgtgtggcaaaagcccagatgggtgtcggcggcgacgacagctggggcgcgcagacgcatccggaatatctgttgcagacggacaaaaccatgcagttttcctttgtatggaaaggcgtggtgagcacagaagcataattacaggatctttacaatattcagatcctgatctaaaagcaggatgtcggctcttgccccgacggcaagggtgccgatttcctgtgaacattcgatgctctttgcaggattgcaggtggcggctttgacggccacgccgagcggaatgccaaactgcaccgcatttttcatacagtcaaacaaattggtggcggaacctgcgatggttccgtcttttaaggtcgcaaggcggccttttttgattaccggctgtccgccgagttcgtactcgccgtcctccataccggttgcacgcatcgcatcgctgattaaaatcatgcggtcgttgccaaacatgcggaaggcattgcggatgaccgacgggtggatgtggatgccgtcacagatgatctctgccatcgcatgcggacagtccgctgccgcgccgataatgccaggatcgcggtggtgtagtggcggcatggcgttgaacagatgggtgacatggttggcaccggcggcaaaggcattttctgcgatttcatacgatgctgtggagtgtccgagtgagatcgcaacggtgtctttgaactcccggataaacgcatcggaacccggcagttccggggcgatcgtgatgatgcggatcttgtttccgcttgcagcagagagccgtcggaacatggcggcatccggcgcgtgcagatagcttgctttctgcgcccctttcttttccggggagaggtatggaccttccatgtggatgcccgcgatgtgggcatatccggcagcatccggcacatcgttaatcgtcgcaaaggcagctgtaagctgttcttccggcagggtcatggaagtcgggcagaatgaagtcacaccgcaggaatgcagatattgtgcgatttcggcaagtcctttggaatttccgtcactgaaatcgtgacctcttgccccgtggatgtggacatccaccagaccggggatcacataaagcccctcggcatcaaataccgtatcgtcttctgcggtttctgcgatgcggtgtgtcgttgtatcaacaaccagttcttttttccgaaaggagccagactcctcccagaccagtccgttttttatgatcatggcgtactccttttcctagatcagtccttctttgatgatgcgggataatgcagcttcatcggcaacgacggaaacctcgtcgtgtaactgcaggattgatgccggtacatgcggggtgatcggtccgtaaactgcctcatagagtgcatcggctttggcttcaccgcttgcgatcagtaggatgtgccgtgcctgcataatgtttttgatgccggtcgtatatgcctgtgtcgggacttcctcaatgaaggaaaagaaacgtgcattggcttgaatggtgttttcggtcaggtcgacgcagtgggtttcctttgcaaaggaatccgatggctcgttaaaaccgatatgtccgttgttgccgatgccaaggagctgtaagtcgatgccgcccatgctgcggatgatggcattgtagcgggagcattccttttccacatcagcttccatgccgtttggaataaaggtgtttacggatttgatgtttacgtggtcaaacaggttgtggcgcataaagtaagcgtaactctgatcgttgtcggcaggaaggcctttgtattcgtcaaggttgatgctgcggatctgtgaaaaatcaagatcgcccttgttgtaccactcgatcagctgcttgtaggtgccgatcggtgaagaaccggtggcaagtccgagcacagattccggttttaagattatctgtgcggagataatgttggccgccttgcggctcatttcgtcatagttttttgttttataaatacgcatagtggtctcctccttaaaattgcgtttcctgcatttgttaagttgattataggatgcaaaattggaaaaatccatagggtttgggcaaatggaaagaacaatccccaaaaacggaaaaaaagaaaaatcgtgtgtgcttttgaaagaactttcaaaaatatatgatataatgaaataaaattacagatcgggttatggacatagagttatatatcccgttggacgtgggcaccataaactctgatgttccgcaagtaactgaggaagcaggaaaaggagaaaacgcgtatgcagacttatggaagcagtgttgtgccgatgatcgaggcaaattatgagatgtttacggtggtggagaaaacaatcgccgatttttttatttcgaatgaaaaagagatggatttttcatcgggacgcatggcaaagatgctacatgtttcagaagcatctctgtcacgctttgccaagaaaatgggttacagcggataccgagagtttatttacaactaccagccctcgatcgcggagcgaccgaatgtggaggaacagaccatccacgtcctgtattcgtatgaggaattgctgcaaaaaacatacagcttaatccgcgaaccacagatcaaacatgtgtcccagctaatcggggaacatacgcgcatttttttgtatggatttggcagttctgggctggcggcacaggagtttcaacttcggttgctgcggcttggcatggatgcggaggcaatcacggaactgcaccagatggtattgaatgaagcgcgtatcacaaacgcgtgcctcgtgatcggcatcagcctaagcggcgcgacgcgcgagctcattgatgcacttgaccgggcgaaagcgcgtggggcagcggtcatatatctgacttcctccaacgcagagcgggaaaaacggacgtatgaggagatcgtgctcgcaccggtaaaaaagaacctcgaatacggaaatgtcatttccccgcaatttccgatcctgctgatccttgatctgatctatgcccagcttttaaaagaagatcggcgcagcacggaagcgcagtacgatacgcacatctgggagaggatcaaggactatcatgttggatagatgtggttttaaaaaccagattgacaggaaaaatcatacatttatactaaatgtgtagtcgaattttggtttaaagtaagattactcttcttccgggtatttcataccccagttgtttcgaatttcagtcatgatatgcataacatcctgtgaataattaagatgcataagtgattcaattgtggataaatcgccggagcatacagcggcttccatgtcagcaacttcatagcttaaggcatctgcagtttctcctgcggaaatagtttctttatgtccgtccccggtgtaagtaatggttgcttccatagctcttgggtattcaaagatctcgatgtaacccttatcgaatgcgatggttgcgcgctttggctgctttgcgtgaagagataaggtgacggttgccatctcgccagctggattcataagaaggatgcctgcctgttcatccacaccggttggtgcatattttacctgtgaaagtacctgattggcagtttcggcaaagaaccagcggatcagggataaggcgtaaacgccaatatctaacatagcgcctccggccagattgcggttaaaaaagcgattattcatatcatattctttatagctaccgaagtttacctgaaccagacgaagtggtccaagagtgccggagcttatgatctctgcaagtttgcggtagatcggcatgtggaaaatggtcatggcttctgccagaatgacatgatttttttccgcaagggcaatggcctcatcaagttcgtttgaatttaaggtgatggatttttcgcaaaggacatgctttccgtttgccagtgcttgacgcagatattgaatatgcgtattatgtggggtagagatgtagatgatatccacatccggatcggtaaagacatcttcaaggtgatcatataccttggcaatctggtatttttccgcaaatgctactgctttttcatgtgtgcggttggcaacggaatacagatgacggttttgcctggcaagtgcagtggcaagttcgtttgcaatgacaccacagccaagggttgcccaattcaatggtttcatagataaatttctccttatttgtatttatactcctttttacgcgctcattttagcatgaaagggcagacggtgcaagtatatgaggacatagtggaattttgttgctgttcacgcagcatctgaatatcatcctgcccgggggagtatgattgtgatgtgggtgtgagcagtaacgaatattttacaggaaaggaaaaatatgtatcggatattagttgtggaagatgatgaagtgattgcaaaaacaatccggcagcatttacagagctggaattatgaagtctttgcagtagtggattttaatagtgtgatggaagaatttgcccgggtaaaaccgcatctggtactgatggatataaggcttccgtttcacaatggattttactggtgtacggagatccggaaagtatcaaagctgccgattatatttgtctcttcgatgaatgacaatatgaatctggtgatggcgatcaatatgggaggggatgatttcatcacaaaaccttttgatctgaatgtgttgacggtgaaaattcaggcgatgctgcgccggacttatgaatttgctggggaaagccatatgcttgagcatcaggggatgtggctgaatctgtcggatgggacactgacctacgaagagcagatactggagttaagcaaaaatgagcggaagattttgcagacgctacttgaaaatccgggggcaattgtaacgagggagaatctgatgatggcattgtgggaaagtgatgtgtatgtggatgaaaacacattgtcggtcaatgtgaaccggctgcgaaggaaactggaaacaattgggctgacggattttatcttaacacgaaaagggatcggttatcagattaaaaatggatcatgaaaaggggaacaccttgaaggtatacatcaaacagtatttaaacagatacaaaggctgttttgcacttgtggcaggaattatgattttctatattttcactctttacctctgtggcgtatccgcagcagatatccggtattttgcgggattggaaattgtttttcttgtggtgtccgctgtattttgcgggatacggtactggtatcgcctgcggacagtaaaaaggcagatccgggattatatgcagggcatgcagacactttcagatacggaggatgcgctggaggaagtgtatatggatgcgcttgaacaactgcagaataagcggcaggaggaaaagggagcatacaggaaccagcagcgggaaatggaagaatattatgctctgtgggtgcatcagatcaaaacgccgatctccgcgatgcgtctgcttttgcagagggaagaacaaaaacagacagaggatgaaacagtgggaatggaaaaaagtgtgttgtatgacatgcagcaggaattattctggattaaccagtatatcaatatggcacttcaataccagcggatgaattccggtatgaatgatctggtgcttgagatggtttcagcggatcaggtggtgcgcactgcgatccggaggtttgcgccgattatgattcgcaaaaagattgccattcactatgaggaatgccaggagatggtgctctcggatgaaaagtggctggaatttgttgtggagcagattttgtccaatgcgattaagtacagcggcgaaaatcacgcggttacaatacatataaaccggaatgaagccgacaatacctgtgagtttgtgatctctgatcagggaatcggcatccggaaggaggatctgccaaggatttttgaaaaaggttataccgggtataacggacgggcagataaaacttcgacgggaatcggactttatctgtgccgggagattaccaaaaagcttgggcatgggattatgatcacatccgaaattggaaaaggtacggatgtgacaattgtatttgaaagaaataatttggatgtccgggattaagtgttttgacgtgggagataaataacatggatactcgggacgtaaaaacaggtatcttacacaaatgtaagatacaaagccgaaatgtaagacaaatcaatggcttgcatttcggttttttgttattctgatactgtaaaaaagggatagagttatttttatgaaaaacagtagaaaaaaggacagatttataaggagtaaaaatcatgacaattttagaagtgcataatctgaaaaaagtttatacgacgagatttggtggcaatcaggtgcaggcactgcgaaacatccagttctcggtagaggaaggcgagtatgtcgcgatcatgggcgagtctggatcgggcaagacaacacttttgaatattctggcggcacttgaccgtccgacggagggagaagtactgctgaacgggaaaaaccttgtgatggtgcgggaaaaagaaattgcagcatttcggcgggagcatcttggctttgtgtttcaggattttcatctgcttgacaatttttcgctgaaggacaatattttcctgccgctggtgctctcaaatgtgccttataagcagatgaatgagtggctttatccaattgcgcagaaacttggcattgtggatattctggagaagtatccgtatgaggtgtccggtggacaaaaacagcgtgcggcggtggcgcgggcaatcatcacaaagccggagctgatccttgcggatgaaccgacaggagctttggactccaaggcaaccgacagcctgttgacgctgttttcgcagatcaataaggaggggcagacggttcttatggtaacgcacagtaccaaggcggcgagccatgcaaaccgggtgctttttatcaaggacggggaagttttccaccaattgtaccgcggaagcatgagtaatgaacaattgtatgcaaagatttcggaaacattgaccgttctgacgacaggtggtgagaactatgaataatctgtatgtacggctggcaaaaaacaacctgaaaaataacaaatcactgtatgttccttatatggttgcgggaatgatcacggtgcttatgttttacattatgatgtttatcaacaacagtgccgggcttgaaaaaatgcgcggagcctattatattacaacaatcatgtcgtttggtgtgattgtggtaggcgttttctcgtatatctatattttttatacaaacagctttatcagtaaaaggcgtaaaaaagagatgggaatttacaatattctcgggatggaaaagcggcatattgcaaaagtgcttgccattgagacggtgtttaccgcgtttgtctcgatcgtcggaggcattgttgctggaattttgttttccaaactggcacttatgctgatttaccggattctggggattcaggtgacgatcgaattttccgttccgccgtctgccgtgaaaaataccgtgctggtgtttggtattttgtatatgatgacgcttttttacaatctgatgcagatgaaactggcaaatccggtggaacttttgcggggcagcagtgtgggggaaaaggagccgaaaacgaagtggcttatggcaattttaggagtagtatgtcttggtgcgggatatgcaattgccattacgacagagcagccaatgaaagtgatcagcctgttttttgtggcagtgcttctggtgatcgctggaacatatctgctgtttacggcgggcagtattgcggtgttaaagctgttgcggaaaacccatggattttattaccaaaaaaagcattttatcgcggtatcgacgatgatgtaccggatgaagcagaatgcggcggggctggcaagcatctgtattttatcgacgatggtgatggtcatggtgtctaccatggtctgtatgtttgcgggtcttgatgatgagattaacatgctctatccgtatgagatcaacgtgcagaccggctattctgaggtgaaggaaaatgtatcggagcagagttcggatattatacagtttatagaggatacgggaacaaacgtgacggacagtgagagttattcgtatctgaattttgcgatgacgttggagaaagattctcttacgattgggcagaaaccgacaaatgcgagcctgtattttctgacgcgagataatttccttcggatggatcacacgctgacagaggcggatgtgccaaaggtagaagccggaaaaattcttatctaccgggaaaaacggttccagtctacgaaaacattgcgtggagatcagatacagattcttggagaaacgtttaccgtacagcaaaatggatactgtaagaatcgctgcaatggaggggctatttcgttcatggacggggtttattatattgttgtggatcatatgcagacgctgcagaagttgcagaaactggcgatcactgaggcaaatacagagaatgtcagtgcgtatgcctatgaaaatgtacttggaatcaatattaccggaacggagacagaaaagatcgcgtgcagcggaaacgtggagaattattcctctggggaaaaatatggcgttgtctggaggcgcgtgcgcggcagggcagtaaaccggaaggagctgctggcactgtacggagggtttttcttccttgggattttccttggcatcgtctttctggcagtgacagtgatgattattttctacaaacaggtatcggaggggtacgaggacaaggagcgataccggatcatggaacaggtgggcatgagcaatgtcgaggtgaagtcagcgatcgagacgcagatccgcatggtgttctttctgccgatcgtggtggcagcactgcatgtcgtggcggcatttccactgatccgcagagtgctttccctgttgattatggacagcgggcagttgtttgtctggtgtctcgttacaacggtacttgcatttgcggttatctattatgtggtattccggatcacttcaaaaatttattaccgcattgtgggcaatcaggtgcgctgaattatttgtggaaagtcacaggcagcataacggaaaatacatttttgtccccctgccgttctacggtaattttgccggaatggttcgtgacaatagagtgcgcaatggacagaccgagtccaaaatgaccgttatccgcgcgtgcttcgtctgtgcggaaaaaacgttcaaacaggcggtcacggatttcttccggaattggattgccggtattttccacggataaataaaatttacggttatggatatgggcgtgaatttcgatatttccgccttccggggtatagcttaatgcgttatttaacaggatggaagcgagattttgaatctgactctcgtttccatccattttcatttgttcctgaacatcaatggaaagcgcaatgtgtttttcaaaagcaacactttccatcggatagataatgtcgagcagtgcgtcatctacagggaaaaccgcatgggtattctggatctgcggggcatccagccgcgtgagcgtaagcattttctggacaagagagatcatccgggaagtttcctgctgaatatacagcagatgtttattgtccctgcctacttcagaagataacagttcggcattggcactaatgacggagagtggggttttcagctcatgactggcattggaaataaattttttctcggataaaatggtattttcaatcggttttaccatccagcgggagagtgctttggaggaaatggtaaatacaataataccgagaattgccagaataaaacagagggagatcgtcggaaaagttgactttaaagcaggggctccgctgagcatcaaaacataatactgtccttttttggcgcggaggtggttgacggaagcataccgcttgaaaaaaacataatttttatgattggaaataagggctttcccctgttttaaaagataatcatcggtcacgccggaaaatgtatcaaacattatttccatttcattggattcatcgatggaaaaaaggcagtatgggatatggtcaagctcagaaggagaagtctggccgtttgagatgataaaggtatcccatgtcgtatagtgcagggcagcacggatggtctgctgcaggtcactgagattattccggtaggaattgttgatgaaaaggaataaaatcaccagccagatgaccgtaagcaaacatataaaaagtgtactgatccttctctgtaaagattcaatcatcagaaacctccataatataaccgactccgcgaattgtcacattgacctgcagatgatgaaattttcgtcgcaggaaggaaacatatacttctacattattgtattctgcattggaatcgaatccccagatctttgtggtaatctggtttttctcgagaacctgattacagttattcataaaaaactccagcagttgcatttcttttccggatacctggacagattttttggtctgtgtgttgcagatttcgcaggtagcgggatcgtaggagagatttccaacgacagggtgtgaagtatcctgatgattgctgcgtctgctgatcgcctgtatgcgcatgagcagttcacgaatttcaaatggtttggtcatataatcgtccgcaccggtagtaaatccctgtatcttatcatcaatttctgtttttgcggagagaatgagtaccggaacattgtctccatccctgcgcagggcagatagaacttcataaccgttcattttcggaagcatgagatctaagataaccatatcataaatgccggtggaggcatgttcatagccgagctgtccatcatttgcggtatctaccacatagttttcgttttgcaaagcttctgcaatggtatccgcaagccggacggagtcttcaattatcaatattttcaattggaatcccctttgctaaatcagaataattattgttgtatttgagatttattatagcggattctggaaatcttgcaattaaaatttgtgtatgtatcacaagtgagagaaaatacatgtcagtctttatataagagcaaaaacaaaaaaaatgaattgttttcaaggttcattcaaggaaaaaaatatatgataaacttgttaataaagtaatgacagaaaggatgtgaaaatgaaaactttatatctacatataggaactccaaaaacagcaacatcatccatacagaaatttttagcagagaactgggatgttttacaaaagcatggatattttttcccggaatccacacatatatatccaagggtaaatgcaagaagaaatgctcattttttgtctggaagagtccgtaatggagaaggaatcagagataaagaaaaagaaaaaacgtatttggaagaaggattacagcaggtcagggacgcttttcaaaattatgataatgtgatattgaccgatgagtctatctggtattgtttatgttatttgaagaaatcgctgctttgtgatttgaaaaaagaggcagataaacaagggtatcagatcaaggtaattgtttatcttcgcagacaggataaatttttgttgtcccgttggaatcagagagttaagcagaaatcaacgagtgatgcagtattatcctgcgatgaatactttgaactaacacaaaaaaaggaaaaagatatataccagtatgggaaaatactggatgggatcgcagaagtgattggaaaagaaaacctgattgtgcgaagattcgatgtggaaagctggagagatggttcaattattcatgattttatgcatgaaataggaattgatgtgacaccggagtttcacgaacttgaaaaaaatgcaaatttatctctggacaagaatacaacggagatcaagagaatattaaatcaggaagaaagtttcaccatgaaggaaatttcttacatgggaaaattcttaaaaaagatctcagaaaactatattcagaaggatcacacagaaatgcttgcaaaagaggaattgcagcagtttctgaaaaagtatgagacggaaaatgaacggatagccagggagtatatcggggatggacagcctttgttttcgaatgaagttaaagatttaccgaaatggaatccgcaaaatgaaaaaatgcaggaagaaattattcagttctttgcagcagttactatggatctcagaagaacgaatgaaattcagcgtcagaaaataaaccagcaggaaaaaagaatcagacagctggaaaagagggcaaatgaatttgtgatgttccgggataaagcaaagcatccgtttcggacgatctggaaaaaattatttcgataaaagggactgggcagatgacagagggtttcaatacacaaagagatgaaaaaacagacagcagacacaatctcacatggcatatgatggatattaacaggcagaagcgcgaaaagcagatgcagcagaaggcttttaccatctggatgagcggattgtccggtgcaggaaagtctacgatagcaaatgtactggagaagcgtctgtatgcaatgggaaaaaaaacgatgcttttggatggagataatgtgcggatgggcttaaacagcaatcttggtttttccgatgaggaccgggtagaaaatatccggcggattgcagaggttgcaaagctgatgaatgatgcaggcctgatcgtgattaccgcatttatttctccgtaccggcatgatcgcgagaatgcaaaacagattattggaaacggctttcgggaagtttatgtgagcacttccgtggaagagtgtgaaaagagggatgtaaaaggattgtataaggctgcgcgggaaggaaaaattgcgcagtttacaggaattaccagcccttatgaaattccggaacatgcagatgttgtcgtagataccgcggagatggatgtggaaacatgtgtgaatcatatattggagcaactgaaaagtctgttgcgagaatccgtgtgagtcaggcaggacagtttatccggtcaatgttttggatcggatgtattggatttggcggaggaagcgcacttattccagttattgaaaaagagattgcagatcgacagggaatagacgaaaaacagaatattgacaaagatgtggtggttgcaagtattacaccgggagcacttccggtagagattgcagcgtctatcgggcgccgcaaatttggaatcaggggaatgatcgcaggtgctgtcatgatggcattgccgggagcgttgatgacggtggctctggtagcggtgttgtctgtatttcaggaaaaaatcctttctgttgtaaatatgatttccataggagtctctgtttttattttgtatctgttgttttcttatatcagaaaaatgttaaaagactgcggggaagacggaaaacacagaaagatgaaagcgatttttttaatgcttggggtttttgtactgtctttttttatttcttcggtgcaggtactgatactggcatttttcagcatttttttcaccagaggcaattacagcaaaaggaatctgataattcttaccggcattattggcagttatctgttgacacatgtacaagtgttttcgtttgatctgtccggatggcatcctgtggttgatattgtgatgggaatacttggatgttatggcattttctgtaatatagcagataccggatggaaaagagagaagaattggggtataattgcaaaggatgttggaacatgggttgtatttgcggcagttttcgtcgttcccgtctggtttgtaaaccatgagatcatgtgtttttccggcaggggaattttgtctgcatggatgtcctttggcggtggtgatgcatatatgaccatagcggatggaatttttgtgggaggaggaatgatcacttcccagcaatattacaatcatattgttccggcggtaaatgtattgcccggatctattttgtgtaaaaccctggcggtagccggatattatacaggatggaacctgacacagaacatagaagttggattattattttctatagcaggttttggatgcagtattgccgcgtcatgcagtatttttatgcttgcatatcatctgtatgattatctgatcacattacaggcatttcgtattattcgaaaatggatcagaccaatcatcggtggtctgttaatgaaaatcatggtgatgctttgcttgcagaatataggtatggtgatgacttttatgaaataaatgtacaaacaggagatatagaaattgagatttacaaaagcaaaaattgtagcagcaggaatgatactggcgggaatctgtatgattgcaccacagcagttgagggcagaggtacccaaaacacagatggatggtgtgatgggacaaagcatcaaagaagagatggatgatacacagatttcagacgtggatacgcagagggacggattgttgtccacatatgccattccacggctgctgggggcatctaaggcatcttccggatatacacaggattttctggatggttcttttacttcgaaagtggattatacaagtgttacctattatcacaaatcggactatgaagatgcgcagcttttgaacggaatagatgtctcctggtggcaggcaaaaaataaaaaaacaacagcacttaactgggaaaaaatacatgatgcagggatagattttgcatttgtgcgtgtagcgtcaagggacacttccgatggaagtatttatgaagatacggctgcgaattcccatattcaggcggcacttgaaaacgacatcaatgtcggtctgtacatattttcacaggcactgacagaaaaagaggcaaaacaggaagcagaatatgtgctggatctggcagataaatacggctgggatgtgacccttccgattgttatagacagggaaaaaggaagtcacaaccgcctgacagggggaaaactctccaaagcaaaagagacagcggtctgccagtcatttgcagatacgatttccgatgcgggatatcagccggttgtttatgcttcctatgcatggatcaaatcctatattgatacagattccctggaggattgcggcatctggattgcgcggtacaataatacgacaacgagcaatgcaaaaagcggggaaccttatgcagacacagcatatgactatgaattctggcagtattcatccgttgcaaaagtgagtggatatacgggaaatctggacgtaaatttctggtacaaggacaccagtgcaaaaaccggaggattgaaagcaactgtggggaatgcatttgacccggtaaaactaagctggggcaaagctgccgatgatgtaaccggataccgcgtgtaccggtatgacgaaaaacagaaaaaatatgtttatatgaagcagacgagtggaaaaagctttacggataccgatgtgacaagcggaaagacttatcagtacagggtgcgctgcttttggaccatcggtgggacaaattattatggaaattattcttcggtggtatcggccaccgttccgccggcaaaagtgtccgatgtaaaaacacaaaagcgcagcagtacatatgtgacacttggatggagcaaaatatcaggttccagcggataccgggtttataaatataacacagcagaaaagaaatacgaaagtgtggcaacgattgcaggcggagcagaagtttcttataaagttacaggattgagcggagctacaacgtacaaatttaaagtgaaatcttataaaaaagcagaaggggaaaccgtctggggagaagcttctgacgcacatgaagagtgcacaaatccgctgaaggtaaaaaatctccggctgcagacaaaatcttgtgcagtcacattaaaatgggataaaaccagcaatgtaaccggatatcagatttaccgttataacagtaaaacgaaaaagtatgataaaattgctactattaaaaataacaaaacattttcctataaggattccaaattgaaaaaggggactgccagtcagtataaagtccgtgcatataaatcttataatgggaaaacgtatgtgggtacctgttcggatgttacaaaaataaaagtgaaataggtaatgattcatgggggattcacacaaataatttcagaatattgaacagaacaccatcgaatgcatttcctaagaaatcaagattctttatataagaattccacacaaaaagccacgcagtaaaatattttgactgcgtggcttacatattatttaatatgaacatggatccatagtgcttcgatggaatcaatcatcatcatcagcaactacttttaccgtatacacgaccgattttttttcacccttggaattagtatagctgcaggtgatctttgttgttccgcactttttagcatagaaatccacttcatgaccggtttttttccagtttgcgaaatcgacaatatccggattactgattttccattttaactggttttccttaatagagtctccctttttcacctctaaatcaaaatcgtcccagacctcctcatacttgacagaagctccggacttccggagagagtaatctttctttgcctctgttacagataccttgatggtgtccccgtaacgatccttgtttttcccatatacatagcaccggatttttgcagttccgggttttacagcaacaaaatccatatcatcaccggttctgtcggagtcttcaaaccggacataggattttccggaaacaatctcccagcagatataatcgtcctctgcatcatacggagaagtctgtgctttcacttcaaatttctttccctgtgcgacgcttcgcttcgactgtgcaagcgtaaccttgtccggtatgccatggtaatcggcacgcgcggaaacggcaccggtacctgtgacagctgctacaataagacatgcggttacaaactgtttcgttcttcttttcatattataaattgctccttaaatcaattggtactttgattacataatgattgtatcatgcaattattagaaaaatattagtaaatggaggcagaagtccggaaaatgcagcctaagattgtccggccggcatccgcaccacaaacgtactgccctgatccaccacactttccacagtcaccgtcccgtgataaaaacgtgcgatctcataaaccattgccagcccaagcccagtaccttcgccaccgcgggaagcatccgcctggtaaaagcggcggaaaattttctcctgttcattgcgggcaatcccgattccgtcatctgcaaccgacaggacaagagaagaatcttcctgccagagccgcacccggatatgtccgttttccctgccatagcggtacgcattgctcacaagattcaccaacagccgcgaaaaaagttccggattgaccgaaatcatgaccgttttcgtttcatactccaacgtaatcccacgctcccggataagcttcatatccgaacagaccgcttccacaagctccgccgcatcaacgaaagcgtccggatacttcccggagcgcatctccagccgggcaaaatccagcatatgattgatcagcttcgtcattttctgcccctgcctgcggatcaccagcagggcatccatatattcttcggtcgtccgttcccgttccagcgtgtagtcacactgcgcggaaatcacagccataggagtccgaagctcatgggacgcatctgacgtaaactgccgttcccgctcgaaagccagctccagacggtcaagcatctcgtcaaaagttgacgcaagctggtgcagctcatcatccccctcgccgatatcaatccgttgtttcagatcatttccctcactgatctgttttgctgtccacgaaattttctggagaggtttcaatgcatgtccggcgatcagatatccgccaacagacgccgccacaacccagagtggcagaagaatcacagcagcccggatcatcccggacatctgccgctccccctgctcctccgacaccataccgcgaagccataaatcgtccagaccgtttcccgaaagcttgcggtcaaacacatagtaccagataccatcagagcggagcttctgaatccgggaatcctcaaaacgcattccggccacaatggaaaacgcggaatcacttccgtatagcagccccgaatgctcatcatacagccccgtgtatacctcattcacctcatacagaaaatcatcatcgatatccagatatcccgaaccatgccgtatcagataatcgtaccgttgctccttcagcgcctggctggaaggcaaaaggtattccacctcatccacattattctccaccgcctgcaccagacaatcctgtatcgttttgatcaaaatctgacggcttaccgcaaaaacagccagataagcaaagagcacgacaacgatcgatgcggcagtaaaccagaccgtaatcttcaagcggacagacaacttctttcgaataggtaacctctttttaacaggcgatttcttcacaatagccaacttccttccttatataaatgacttcttcataatcgatacccccctgccctcagacctcttcccgcagcacaaaacccctgccgcggacagtgtggatcagtttgcggtcaaagccatcgtccaccttcctgcggagatagctgatgtagacatcaaccacatttgtcccaccttcataatcaaaattccacacatgatcctcaatcatttcacgcgacaacacacgcccctgattatacatcagatattccagcagagcgtactccttcgcggacagatggatttccattccgtttcgtgcaaccgtgtgcgcactgcagtccatcgacaaatccccgatacaaagaacattgctggaggcaccgaaagaagtccgcatcatcgcacgaagccgcgcggacaattcttcaaaagaaaacggtttgacgagataatcattggcaccccgatccagtcccttcacccggtcggaaacagaatcccttgcggttagaaacagcaccggcgtcgtccgtttcatgcgccgcagcgcatccagtacagcatacccatccgccttcggcatcataatatcaagaatcacagcgtcatagtcggtgtatgagagaaccgcaatcgcttcctctccatcgaagcagcagtccacactgtaaccgtcagcggtcagcttttgagcgataatgtgatttaaatccttttcatcttcagcaagaagaatccgcatagtcatacttcctttccaaatttagttttatcagtatagcagaaaaaaaacaaaagcgccacacctgatttcatctccataatataaacacaaatacatcatatgtattaaaattagcaacaaaacaaaaattacgaataatttaacataaaacgcaaaaaggaagacacaacaagggaaaaattgttcttgaaaccattctggagccgttacatgcaatcgaggatgtggcaaaggatttaacagaaggaaatctgcacagcacactggaatatcgttccgaggacgagatcggaagactggcacacagcatgcgcaagtctatccgtattctgggatcttatgtagatgatatcgaccgcgccatgaaactttttgcggagggacattttgatgtacagccggaagtagagtggaaaggtgattttattggtattttacactcctttatgggatttgagaaaagcatggcagccacgattaaaggaatccagaacgtgtcaggcgaggtttccggtgcggcagaacaggtggcatcaagttccaatgatctggcagatggtgcgaccaatcaggcagctgttgtggaagaactgacggcaacggttgcgggtgtgtccgaacaggtagaatcgaattcacatactgccaaggaaatcagcgaaagagtagatgaacttggaacttccatctgggagagcaatggaaggatgcaggagatggttacatccatgcatgagatcaataaagcatcccaggagattgacaaaatcatatcaaccattaatgaaattgcatcccagaccaacctgcttgcattaaatgcatccattgaggcagcgcgggcaggagaggcaggaaagggatttgctgttgtggcaaatcaggtaaatatgctggcagaccagagtgcacaggcagcgaaggaatctaccacactgatcgaaacatccgtaaaagccgtggaaaacggtatggtcattgcagaacggaccgcaacacagctggaagaagtggcagaaagctccaaagtgattacaaaagaagtgacaaatattgcagagacactcgagacacaggcttccgagattcagcagatcaatgaaggcattgatcagattaacgatgtggtacagacgaattctgcaacttcccagcagtgcgcagctgccagccagcagatgagcagtgaggcagaaagcctgcgtggaatgatcagtaaatttaaaattgcagattttgaagcataatacaaaaaggcagagagcagacaatatcagtggtctgttgggtgaaagggaaatgcatgttgattatctgcagggctatctgtttggaaagccatgcggcaaaaaagagttttatgaacagtttgtaaatagcgatggaaaataattatcggaatatttaaggaagtagttgtatggaaacaattttccggatgcgacggagcggcaggtcacagtggaaatattcaaaagaatctttgaaaatattgaaaaaatagaaattaaggcactaggcggcaggaaaataatactcagccttggtgcatgtatttatgatgggacaggggatatcagctatgataccctttacagcaaggcagatgcagccatgtaccggagcaaaaaacaacagggattttgtgctacggtacatggggctgcggacgaggtttttataccttaactgttgggctgaatccgcttccggttatagaccagatgcaggtacattgcatcatgggcgcggatcgcatcgtgggctgcaattgcgtctgcaatctcccggtgtgactcaatcgtttcattacgcaatgtgtttccggtactttctatgagaagtgggattgatcggaaaataacggaaaccagtcgtggaacaacaatatttttgctgctcagtgcaatggcggtatgcagttcaatgtctttggcagagtgatccttatgggcgtttaacagttcttcgacttcatcacataaggtatagattttttggatttctttatcttctgcatgcatggcggcaagggctgcaatggaaggttccagcagaaagcggatttccatgaggtcatggatcagcttttgtttgttctttataaaattaagcccaagcggatcgttaataacacctgtggaagatgcgacataggtgccggatccctgccggatggtgacgatattccgtgatgcaagagccttcatggcttcgcggagagaacttcttcctacatttaagcgttcacacagaacggtttcatttggcagtttatccccgggttgtaaattttcttctaatataaatgcaataatgtcttccgcaatttttttcgggagactttttcttctgaattcgtcatatgatttcccattctttagatatataaatagaaacaatttaagaataatgctttttgaaccgaatgtcaaagtagactggtggatactatccggaaatagttggtatttgatactgtctgaccgcatcagcaccaccagacaggaagagaataaggagaatagcgacgatccatgggaacagtgtggtaaaaatgttatacaggtctcccagtggatcctcgctgtaatcccagaaaggtctggcaggatcatcgatccagtagacatttatgattgtccgcagatgggatctggtactgcttagcggagaacaggagaattttctgcagtactcctttccggctaccgtgtaagtataccttgccgcccagtaattatggtcggaatttgaccggttgaccgtgattctttttgcatctttttttataatcattccctttgtgacatgtccgcgttcttttgcaatttcaatttttctgctcagcccaacttttcttttggctaaaaacttcagatcaatgatgtacagtggtatcagcgatataacggctacagttacctgccatggatactggcggatggcgttgatgatttctttaaattccatgatttcccccttttttgcttcatatcaggaagcggttttgaacacttttccggtactgccgtctcttatgcggtcagaccatggaaaggaatatggtctttgtatcctttattataggaaaacagggattatttggcaataaaaaataactgtaaacgttttcacatattaggcatatctatctgcacatttcataaaaacataacgacaattcagaataaaatccccggattatttgtccttaaatcctgtaaaacaaagcatttttggaaaaattatattcatatcaatcatgtatgaatatagggaaataaaacgcaaagggtgaaaacgatttcacgttttgcctttgtcatttccatactgccacgtatataatgcaggcaacaacaacacagggaggtgtggaaatggaaacatcaaacattatagaagtcacacatttaaacaaacagtttctggtggataaacagccgatggaggtgctgcacgacatcagtctgcaggtgaaacagggagaattcattaccatcgtgggacacagcggatgcggaaaaagcacattgttaaaaattatctgcgggcttgttggctatgaggacggacaggtggagcgcaacggacatccggttaccggtcccggaccaaaatgcggcatggtgtttcaggatcaccggctgcttccgtggttgaagataaaagataatgtaggattcgggcttggggatctgccaaggcaggaaagggatgaaaaagtaagaaaacatctcgagcttgtagggctggcgggatttgaaaacagttatccgagtcagttgtccggcggtatgtcacagcgtgccgcaattgccagaggactggcgaacaatccgacgatcctgcttctggatgaaccgtttggtgcgttggatgctttgacaagaatccagatgcaaaaagagattctccggattcaggaaaaagagggcacgacgatggttatggtaacacatgacattgacgaggcaatctacctgggagaccgaatcgtggttatgtcagcaaggccggggagatcaaggatatcatagaagttgaccgggcagcggcgggaaagcgcagcggagcagaatttgctgcatataaaaagaaaatttatgattatttctttgaagacagtgatgagaaatatgaagttgagtatgtgatttaagggggaggaaaatgcgagtaaaaaaattggtattaggatttgtaattccaatagtaattcttgttttgtggtatacggcaacgacatttatgaatgtcccgacaacaattttaccaaagataagaaatgttattgtgacagctgttgatatgtcgaagacaggacaacttccggtagatttaggaatcagtattgggcgtgtggttaaaggatttttggtatcagcaattgtaggagttgtattgggatctgcgatgggaatgtcagagactgccaaagaactgttacttccgacaattactaccattcggcagattccaatgatagcatggattccacttattattttgtgggcaggaattggggaagcatctaaagttattattattgtaattgcagcagtttttccaattcttgtaaatacgatgagtggaattactggaactccaaaaggatatgtagaagtggccaaactttacaagttgggaagatggcaaacgtttacaaaagtatttttgccgcatgcgttaccacagatgcttgtagggcttaagttgggattgggggtttcttggatggccgttgttgcttcagagctgattgcagcaacttctggtattggatatcgaatgaacgaagcacgcagcctcatgcgatcagataaagttatcgtttgcatgattgttattggaattgttggaattctgatggataaggtaatcagtgttatttttgaaaaaataacaccttggatacaaattaatgaaaagaaggcataggaggatatgaatatgaaaaagaaaagtatgattttaagtgcaatattagtgacagttctggcgttcacaggatgcggaaatacgcagacaaacacaagtaatacaacaagtgatacagatggttcacagcagagcaatgaaaaagttattagaatcggatcgccgactacagatggcacacaacttgtcgagaatgcagggcttgcatacaagttggggtatttggatgaagaattagaaaaagttggatataaagcagagtatgttgggtttgcacagggcggaacagcaattaatgaggcatttgcatcgggacagttagatgtggcttttgttggagatgtgccagaaataattgcaaaaagcaatgggcttgaagtcgagttatttgcaaatttaaattcagaagctgagatgggaattgtggcaggaaaaaattccggaattaaaaagccaacagatttgaaagggaaaaaagtagtagctgcttatggaacggtgacacatgtatatttgaacaatcttttacaggcaaatggtttatcactggatgatgtagaagtaatcaatgatattgcaaatggtggaactttagttgcatctggaaatgcagatgcggttgtttctacaggtacaggtgtatggcagatgagtaattcaggagtaggagacatattgacaacatcgcagggggatgcagagttatcttctcagttttttgcaatgggaagaataagttatttgaaggataatccagatgcagcagaggcgattattagagcattgcggaagtcaaaagaatatattgaacaaaatcctgaaaaagcatatgaaactcttgcaacatcggataatccaaaagagttgtatgaaaagatatatccgaaggaacttggttttgataattttggttcacaaattaagcaagaacagatagatcgtctgaattcacttgctgaatttttactgggaaatgggacaatatcagagagtgtggatgcaaaaagtgtaataaacaacgattattatgaagcagcaagtaaaacgtttacaaaataacaggaggacatataaatggcagaatttaatggaacaatcggaatcacaaaagaagattccattagcagctataaatcagaaaaatctttaagtaacagaccaaatattatgtatattgttttggatgatgtggggtttgcgcagcttggatgctatgggtctaccattcatacaccaaatattgacaaactggcagaaggtggcctgcgttacaataattttcatacgacagcaatctgctctgcaaccagagcctctcttttgacaggagctaaccatcacagtgcaggtgtttctacagttgtagatacactggatggtagtttcccaaaccagacaggttatatgaatccatcgtatgcaacgacagcggaagtattaaaaacttttgggtataccaattttgctgttggtaaatggcatctgacaccgtttaatgaagccacagatgccgggccgtttcagaattggccacttggaaaaggttttgaccgtttctatggatttatggaaggatatacggatcaatatacaccggatctggtaaaagataatgagcgcatccgtgcaccaaagacaccggaagaaggatatcatttgtcggaagatttagcagaacaggccattcgcctggttaaccgtcagcacatggtatatccagacaatccgtttttcctttattttgcattgggggcagggcatgcaccgcatcaggcaccgaaggaatatatagatcattataagggagcatttgatgcaggctgggatgaaatccgcgagcagtggtttgcaaatcagaaacgccttggtattgtgccggaaaatacggttttaaatccgagaaatgagtttgtaaagccatggaatgaactgacggatgatgagaaaaaagtgtatgccagatatatggaagtatatgcgggatttttggaacatgcagatgcacagattggtaaagtagtagactatttaaaagaaatcggagaatttgaaaatacggttattgtactgctctccgataatggagccagtgccgagggcggaaaaaacggcagggtaaatcaggaaaaatcattgaacctgttggaagagaccaataatgtagaattaactttaaaacatttagaggaactgggaagcagtgcatattcaaatccacattatccggttggctgggcaaatgcaggaaatacaccatttcaatggtataagtcctgggtacattccggcggagtaaaagatccattgattgtgagttatccgaaagggatacatgcgaaaggggaaatccgtaatcagtatttgcatgtaattgatattgcaccgacaattctggatattcttggtgtagataagccggatcatattaagggaattgcgcaaaaaccatatcatggggcaagttttgcaggaacatttgatgatgcagaggcaccggatgtcagacatatccagtattatgaacaggccggaaaccgtggaatctggaaagatggatggaaagccatcacaaatcatatttatgacaaagattatataaatgaaacgtgggaattgtatcatgtagcaaaagacttttcggagtcagagaatgtggcagaacaatatccggataagttaaaagaacttattgccttatggtatgtgcaggcaggaaaatatggcgtcttaccattgggggatggatcatatctgacgcaaaagccggaagaactgcttaatgtcgttaaagaaaataagttctatattgagccacagaaatttagttatcatggagtattgcatccgttggatattacgacaaaaactatgtttaatcgtagaaatcataagattacggttcagattgctcatgaacctaatcaggaaggaattttgtatgctgcaggaaaccgttttggaggttatgttcttttcattcaggaaaatcgattaaaatatgcttacaattatcacagagaacaggtatttcaggtgacatccgcggatccactgccagaaggaaatgttactgtgcaggtacagttccggttaacggataaaggcacagcagttgcagaattatgggtaaatggcatatcacagggaaagacggaaattacaggctttattttcatgatggagacacatgcatacttgaaagatggtggaacatctcctattatagatgattataaactgccatttgagtacccttcaccacttttgaaagtggaaattgaagcagcaggattctgggcagataaaaaagaattagaggaacaatttttccgtattgactaaacacaaggaggaaccactatgccagcagccagtatcttaattaaacccgcatccgccaattgcaacatggattgtaaatactgtttttacaaatgtctcagcagtcacagagaggaatacagtaagggattcatgaaggaagagaccctggaaacccttgtccgggaagcaatcgcgtatgcggacggttcactcacctttgcatttcagggaggcgagccaacgctggcagggcgggatttttttcaaaaggcagtggaactgcagcagaaatataacaataaaaaactgcagatcgaaaacacgatacagaccaatggtctgctgatagatgagaaatgggcgcgttttctgggagagcatcgttttctggtagggttgtcgctggatggtccaaagaaaatgcatgacaggtatcgcaaggatgccggaggacaggatacatttgcgagaatcatgcattccgtgcaactgctggagcagtaccaggtggactataatgtagtgacggtcgttaccaatgacacggcaaaacaggcttcatttctctataaattctggaaacgcaaccattatccgtttgtgcagtttatcccgtgcatggatgagatcaaacggcaggatgggacgcaggagcgcagcatttatgcggtggaatcggagcagtatggaaaatttctgtgtgagctgtttgatctgtggtatgcggattttgccgcaggggaggcgatggatatccgtatgttttccaatctggcacagatggcggcaggatatccggcagaggaatgtggaatgaacggctgctgtaactgttattttgtggtagaaggagacggaagtgtgtatccgtgtgatttttattgcatggatgagtggaaactgggaaccgtgaacgatggatttgtacagatgaaaacttctgaaaaagcaaaagcatttgtggaggcttccagaccggtctgtgcaacctgtcatgaatgtccgtatttttctctgtgcagaggcggctgccgcagatggcgcgagccgtttgtggatggaaagccggggctgaatcagttgtgttctgcataccggatgttttttgcgcatacggcagaacacatggaaaggctgggcgcatatatccggcagaaatatgcgggaagtggaaaatagaaaaatacttgacataaacacctattaaacatagtatataactaggaaatgaaacggaactgtattgccataaagattggatggttggaaacacttagaacagatgctatgccagaaagcgcactgcaggggaggaaaacgtgatatgtcaatcaaggaaattgcagaaaaagcgggtgtatccgcggcaacggtttcccgtgtactcaataatccaaattacaaatgctcttctccggaagtgcgtgaccggatctggaaagcggcgattgcactcaattatacgccgaacacagccgcccgcaatctgaaaatggggatacagaacaccgaaaaaaaggtttattatatcggagtgcttatgacccgaatggagaaagcaacaacagatccgttttttaacgaactgttgcgggtgattgagagtgagatccataaacagattgcaatcctgacaaaagtatggtatatgccgcttttttccaatgacaaaaaatgccggcgggagaatctcgaccagatcattgatggaatgtatgaggaaactgaccagaaatgtgatggcctgattattatcgggaagtgcaataaagaggcattaaagaagctgaatcagaagtacaaaagtgttgtttcagtgaaccggaattccaccaattatgaggtggacgaggtgctctgtgacgggcagaaggttgccatgatggcggtggagtatctgatctcactggggcaccgcagcattgggtatgtgggtgactgctacaatgaggcgcgttatcgtggatatctggaagcgttacataaacatgatatggagccggaggcagcgtatattttgcagacggggcagaccgaggcggaagggtacgaggccatgcagaaatttctgcagtcggaggaccgcccgacgggaatttactgcgcaaatgatattactgccatcgggatgttaaaatatcttggcaccaacaaaaaccgctactatgtcccttccatcatagcaagtgatgatatcgaggaggcacagtatacccgcccgatgctgactacggtggggcttccaaaagaagagatgggaaaatttgcgttatacctgttgatcgaccgtatgcgcggtggacataaaagtgttgtgcgcacggaactggaaggaaaacttatgatccgcaatagctgcatgaccgccgatgagggtgggtggagcgattactgtatctgaatttatatggaaatgcccgcttttatttgatgatcaatcgccgtccgatggagtgatgattgtatttgaatctacaggggtatctcttgttttgtacttgtagatttgatttaaatttctgacgctgtggccgccggtagggcataggtttgcaaaaccgaagttgagggttcgaatccctccagtgtcatttgtctggaacgttgggacatatgggtgaaaggttcgttaaaagtcccgtagtatggagccacagggacatatagaagaaaagtctcgttaaaagtcccgtagtatggagccgcagggacatgtgcagaaaaagttatttattatgtcctgctttcagaaattacagggacatatagagaaaaagttttatgttatgtcccattagattgcgttgacaggacataacagtaaagaaattctccatatgtcccattacatttgcaccgcgggatatatatagcagcttttcctccatatgtcccagagtagatgaaaacaaatagctgaattgtaattgggctcaaagtccgctatactgtagtcataatatggcggattatattttgtggaggttcatatggtatgtaatttaaaattgccggtaggaattgacagttttgaaaaaatcagaaagaatgaattttattacattgataagacaaagcttatagaacagttggtggaaacaggaggagaagtaacgctgtttacgcgtccacgtcgctttggaaagacattaaacatgagtatgctgaaagctttccttgaaacaggtgcggatgtgtcattgtttgaaggcttatatattgcagaaaacaaagcactttgtgacgaatatatgggaaaatacccggttatttttctatccctcaagagcgtggagggattgaattttgaagcagcaaagtaccgtattacggaattgataggaagggaagcacagcgttttgatttccttttggaaagtgacaacctttctgacgatgaaaagctgcaatataaagcaattaccgggatgcaaaatggaaagttttctatggatgaggatattttgggttcaagtatccagatattgtcatatttattatgcaggcattttgggcaaaaagctgtaattcttatagacgagtacgatgtacccctggataaggcatttgagaatggttattacagggagatggtctcactaatcagaggtctttttggaatggcgttaaagaccaatgacagtctggcatttgctgttctgaccggctgcctgcgcattacaaaagagagtattttcacggggcttaataattttaaagtgttgtccatccttgatccaagatttgatgaacagttcggctttacagattatgaagtaaagaaaattttggaagattatggtctggcatcgcattttgaggagacaaaggaatggtatgatgggtatcattttggcaaggctgatatatattgtccgtgggatgtcataaactatgtggatcagctaaagtatgaccagaccgccggaccacaggatttctggtcgaattcgagcggcaatgccatagtccgaaggcttatagataaagcggacgtttccacaaaaaatgagatagaacgtctgattgcaggggagagcattgaaaaggatgtagcaccggaacttacttatgatgagattgataaaagtatagaaaatctatggagtgtactttttacaacgggatatctgacacacaagggccgcacggagagtggaaaataccgtcttgtgattccaaacagggaggttagaaatctttttgttaaaaaaatcagagagtggctttccgatgtgacgaaaaatgacggagagacgcttgataagctctgcaatgcatttgtaaataaagaattggaaaaaattgaggagatatttggtgattatctctggaatacgatcagtatacgtgacaccgcagttgccaaagaaaagaaggaaaatttctatcatggtattttactcggtcttttaggctacaagtcaagctggcttataaagtcaaatgcagagtctggaacaggctatagtgacatcttagtggaggttccgacaaacagaaccggaatcgtaatcgagctcaagtatgctgagaacggggatcttgatgcggcatgtgaagaggctttgaagcagatcaaagaaaaagattatgtggcaaagctaaagcaggatggaatgaaaaatttcatcaggtatggaatcgcgtgctttaagaaggtgtgcaaggttgcgcttggagaataacagattaccattcactcctttttcctgccactggctctgattaagaaaatcaaaattaaaaaaaatgaatactaaattgcttgacttaataagaatgagaatatattatacttatataaaaatacttttgacataaatggcatatgctatttatataattgggatgcaactcctgatttctccgctgcggagagtttaaatatgagcagaatgaaaataaagttgcgtgaagaggctctgaagcgattcagagtcttttttcataaaaggagattgatttgtttagagcagaagaactgtgtggactttcaataaaacctaaaattaacgatattgaccttaatgttttgcaggattactatagaaaatttttaaatccatttgttgggaattggatcaattgtaaaatattcagttcctaaaaagaaaatatgtaattataaggggcaaggatgaaaatgcagttatacatcttggaataaaaaaggatgaagtattgggctattatattccgaaaactttctttgttgaaaaacttggagtgagtggaatagatagttacatagacaagcaaaaaaagataatagcaaaaaagaaaaacagaattattatgttatagagatatactttgcaacataaataaagatcttgtagagtgaaaatcgttctatgaggtcttttttatgataaaatcatcattgaacacgttttcataaaaacttccatctcatttccattttcacacaaaatccctataatcctacccaaaacatgtgaaactttttatattttcaactgtgggaacatatgaggaaaaagatttgtgaaaagtcccacgagttgatgagtctgggacatatacggaaaaagatttgtgaaaagtcccgcgagtcgatgcgtttgggacatatagagaaaaaaattcgagatatgtcccaagagtctttgtagaagggacataccaataaagaaatatgctatatgtcccatctgttttgcttggtgggacatatatgacaacttttcttgcatatgtcccaagttagatggaaagagggacatagatcgttacatatcgtgcatatgtccaaaaagtagatgaaaaagagggacatagctatacatatcgtgcatatgtccccggttagatgaggagcaccacaaaataataagaaagttgaaatagcatactacttgaagctgacttcaaaaagtaaattccagtgcaggggtaaaatccactatatatctcactttgtgcattgtccaaaaaagaatgaaaattgcaccagaatgctatgcaatttgtgaaaaagagaataatattgcaattggtgcagtggaattgaagctgaatggatatacggatatgacacaaagagacgatgagtgtgagctgggatactggcttggacaaccatttgggggaaaaggctatatgccggaagctgccagggaatcattacggcatggatttgaagatctcttttgctttttgggtgcaaaatccttcatgccaggaatagcacctccggctacagcccagaaatacaggcttgccacactgcaatacggacttaatctccgccggtatttttcgaacagtttgcggtcaatttttctgtggtgataaaccatccgcatgccgcgttggattgccagatcaccaaaactcaatacatttggacgctgcatacaaaacaacagaatcatttccgcggtccagacaccaattccctgtaaagaagataattcttttatggcttcttcgtccgattttttccagattccgtcaatatcaaaagttccgtcctttactttttgggcaaaatcagtaatataccctgcctttctgaaggaaattcccagtgactgtaaattggaaactccggcactcagtatggtatctgcgttaatgataccatactgatcattcattcttttccagattgttgcctgtgcttttgttgaaatctgctgaccgatgatatgatgaattacagctgaaaataaatcggtgtcaacttcccgttcaatcattccgattttatcgataatttctgcaaggcgtttatctttctgcttgaggtatgtaatctctttttctccgtatgcaaaaaacatttttatcgtcctttttataactgcattataataatttaccatattattataacacttaacaggacaataaaatcatcaaaaagcatagcagaaccaagtttttttttggatgaaaaacgatccggaatcaaagaaaatttattccattgttgttgtggtgggaattgttatcgtgattgctggattattaaaaatatttgttttcggataagaaacttcgaaacagcggtatcaggaaaggtgaaaaatctttatggtaccgctgtttttgtgttaatttttattttaattttcgaggaaaagacacataaagagatttctcctttttcgcatggcaaaagtgagttataattatacaagagcaaaaagtttaaaacgcaggcagaaggagaagaatcagatgaacattcgaagagcaagcgaaaacgacatcccaagactgatcgaactgttagagcaggtgcttcagatccatgcagatatccggccggatatttttatcccgggaaccacaaaatacacaaacgaagaacttacacagatgataaaggatgataccaaaccgatttatgttgcagcagatgagaatgacaactgtctcggctatgcattctgtcagttgcgggagcagccattttccaacaatatggtgccgtttacctcactttttatcgatgatctgtgtgtcgatgcaagtaccagaggacagcacatcggagagaagttgtttgtgcatgtaaaagaggaggcaaagcgtttaggctgctatgaagtgacgcttaatgtctgggcgggaaatacctcggcggagaaattttatgaaaagatggggctgaaaaccaaggagcggcagatggagtatattttatgataaatattcgaagtgcaaaacaaatggatcttgcccagattgaaacgatatataatcacattcatgatgaggaagttggcattgtaccgtgcgtgtttaacgggattccggatgtacagcttgtgtgtcttgaaaaataccggctaatctaaaatataactttagattagccggtattttttattgattttgtatatattaacgaatataataaaatcagagttaagattagccggaggtttgttatgccatatatacaaagagcgataacgccaatattgaaacaaagagtgtctaccagcaagtgcatgttactggtaggagccagacaggtcgggaaatcaacacttataaagcatgaattcaaggattttaaccgggcaaattttgatgacagactgacaagaatgcaggcgaaggaagaacctaaattgttttttttaaacaatccacagccgctttttatagatgaggttcaaaaagaaagcagtattctggaagatatcaagcagattgccgatgaatcggatgagcgagggatgtttcttctttccggttctcagaaacttgaacttatgaaaggcaagagtgaatcgttggcaggaagagtgtcaatctcagagcttaccggattatccatgcgggagatttatggggtaaaatttaaccggcattttatcccaaccgatgcatatatcaaagaacgtgaaaaagagattgtaaaatatgacaatatatgggaaattatccacaaaggatcttatcctgagctttatgatatagacagggactggcaagaatattattcttcttacgttgcaacttatctggagagggatatcaatgaactggtggcggcagatggtattacatttaccaaatttctgacggcagttgctgcaagaacaggtgaacttctcaattattccaacatagcaggagacgtcggggtaagtgagccgacaattaagaactggatatctattttggaaagaaccggaattgtatatctgctccagccgtatagtgcgagcgcacttaaaagggcaataaagacaccaaaactttatttccgggataccggactggcatgttatcttaccagatggcttactgccgaaacattgaaatgttcagcggttgcagggaatatgtttgagacatttgtagtgtctgaaattttaaaatcctattccaacgagggcaaagattacagatttaacattttttattacagagggaaagacagaaatgcttccggtgaaaacgaaattgatcttgtgatagaggaggatggagtcttatatccggtcgagattaaaatgtccggcaatcccaaagcaagtatgggagcaacgaatcaggtattggataaggtaagtgataaaaaaagaggtcttggagttattttatgtctgattgataaaaagacatatttaagagaaaatcttgtagcattaccgatcgaatttatataaaaggggtgatcccatgatgctaatgtgtaaaaacacacctgtttacgacattgagaaagaaaaaacattaaattataatcttcttccgggactgatgcagcaaaaaggtgcagacaatcacaccttcacgaaatggatgaaataccgctattcctcaggtaccaacacgatagcacggaaattaaagggcatcacattcggacagtgagcgcgtatgcgcattaaccgtgagaccagagcgttgagtttcagcgactgttactggataaaagccgaagatgatccgatatattttgaggagatcagtccgtattacaaatctttctgggacggaaacgaagaatttacaggacaggcggcaccgacactctacgttggtggtgcactgtcaaaggaatggaaacaggacggaaagctctacaaatatggcgatatttccgtggaactgcaatgtattaagctttgcaggaaatgcggaatttctgtagaaagagcagatgagacagacggaggaatcgcaatttctaatataacctccccaaaggtgatgcttgagcaggcagatcagtcgggaagaattgatccggatgattttgatgagcagacgattatagatctgtttggaaaagccggagcgcaaatgcttattatagatgcgataatcggaaatggagatcggcatgcaggtgattttggctggattagaaatacggataccggagagtatgtgtgcatggcaccgttgtatgactttgatcatgcattagacagcacattagagtctgaccgacttttaacagatgcggttaaattttgtatgccgtatgaggatgagatagtgcgcattgcgggtatagcccagggatcggaaaacgaagtatttaagaaacgggcacagagcattatgaagttgcttgatgccggaaaatgaggtagtgatgtacctgaattcggaaatattttctatgaagcaaaaatcagaaaacaattggtgcctgacacaataaacaacgggcgagacaggcatagaacaaagaattatgcagctttttccacctcaaatttccagatatgccggatttgtggcaaaagtcgatccatatcccagtgtttttcgctgtttttggggctgttgggatcattgacgacaacgcgtccttcggaatcgatgccggtgagaacaatgaaatgtccactataagtaaaatctccgggcagcatggagcagatcatcggggtggatgaggtaagattttgccggatataatcgttatttatggttccctctgtggatgtaaggcccagcttttttgcacctgcagtcatcagatcccacgaagtgccctgtccactgatataataaccctgtttttgcgaaaattgtgccactttataaggattccacgttgcttttccagttaatccgcagataaccatagaaagtgaagttggaccacaaccattgacaccaaggaaattgctgccatatgttttgtacccccatcgcttatcccactggatgaatagaggaatgttgtcttttcttacttcgtgtgacacatcaaggtcaaaggatttgtttttgtatttgtgataattttctacaaaatcggttgcttccggatatttttgctcaaactcgataagagaatctgggagttgttcgtgcatggctgtttcgtgggattgatgggaataaaatccgatgatgatgaaaaatattaaaaataatggtagaaaaatttttcttttgcgtttcttttttttctgtttcattatacgttctcttttcttttgttttcctaaacggatagtttaagcatagcatatatgttttaaaataagtcttaatatttcttaacaaatcttaacatttttacagagtgatattatgttataaaaatatggtacaatactatataaattaaataatgcttgataaatgggagaaaatatggatgaaataacaattttgattattgaagatgatgaagatatccgggaaagcgtaaagatattgctggaaaacgagggttttcatgtaattgaagcggataatggaatggatgggctgcaccagatttcagaggatacggatcttgttattttggacattatgatgcctgggatttctggtatcaaaacctgtgaacaaatacgcaaggtttcctatgtgccgattttatttttgaccgcaaaaagcagtgagaatgataaaattatcggatttacagccggggcagatgattatctggtgaaaccattttcttatgcagaattgctggcaaggataaaggcattgttgcgtcgaaaacaggtttatacttgtggaaacatgaaagaaaatggacaaaatgtgtggataaaaaaaggagatctgaagatcaatactacaggaaataaagtattttcaggggatgaggagatttacctgacggaaacagaatatgaaattttatcattaatgctgaaatacaggggaaaaattttttccgtacaaaacatatatgagagcgtctggcaggagccgtttttcaataattctgcaaataccgttatggttcatattcggaaattgagactgaaaattgaaaagaatccgcagaaaccgcaaattatacaaacggtgtgggggaaaggataccgcattgaataaacgaaaaagaaaacatctgatggaaaaaatgatcggaattctgctgttgggattatttcttgcactgctgttgtttttgcttatattttttatgggaaatggagcattaaaccggtattttgaaagttctatgtatcgaagaaatgtttctaaggaaaccatagcaatgtttcaggaatatgtatccagacatcatctggcggcttccgacacggagcgtatccgggagtgggcaaaagaaaaccatattgggtattttacgatttcaagaaagcgcatgctgctttacgataattattacgcacttccagttgccttggatcgtacaaaatcagagcaattacactatacatggcaatattttcaagaagtatcgtttacagatgggaatgcagatgtatttatatatgtgaatcgtgagcgaaagtattatatcctggtagatgtggctgcggcactttgtggtgtgctggtctggattggagtgtttgcgtttggtgtaagcggatatgtacggtacatcaggcaattgagtggggaagtagcgaaactggaagatggattatggtcggtggattttactataaaaggagaggatgagctgacagatctggcacgcggtctggagcatatgaaaacagttcttttggagaaggaagaaaaagaacgaaatatgaaaaaggcacagaataaactggttctggggatggcacatgatttgcggacgccattgactgcattaatggcatatcttgaaattataaaaagagaacccgaacacgataaggtgaaactttatgcaaagaaaacagtgggaaaagcgattcagattaaaaatctttcagatcagctatttgagttttttcttatcaattcagggcagcagccacagatggaaaagtcggaatccatagcttttgtaatggaggattactgttcggaattgtgcaatgtattgcagacaaatggctatacggttacactgggatggaaacagtgggaggaagtaaagataagtgtttgttatgattatatcggacgcattatgaataatttgttatccaatcttttgaagtatgcagacaagacaaaagaaatcctgttggatatgggaatttgtcaggacgagtttttcttttccattatgaatgcagcggcaaataaagaacaggatcatagaggaacgggaattggggttcataatattgaaatcatgatggagcaaatgcagggcagatgcgaagaagaatgtggggaggagtcttatcggatctgcctgtattttccattagaaaaatcagaaaattcataaagagactttcaccttctcattgatattcaggcaaagatgtctgagggaaaatcggctggttatgaaaaaagacagcaagaacaggagccacggcttgtactcaaatcagagtacaggtcgtggcttttcatactatgaaatttaatagcaacttataaatttactaatatcttgtgataaacgagcaattctcctaaaatgtatttgaaccattggtgtctgacacaataaaaagtattaccgtgactgccccttgcggtagtacatgtaggagtagatcaccggcaaaatgcacgggaggatggcgagcaccataagcacccagatattctggaacggcgtggtgacgatcagaaggagccctccgatcaccatgcattttccaccgaaccggtgcgtgtgataccagttatcggcatcattcagcgcccacgaaatgcggaagccaatggtgtaattcggctttaccgtcggcaggaagttgcctaatatcaagtataaaactccgatgagcagcccacaaagaaaaccaatatcaaactgataccctaaattatacccataaaccgtgctgcatacaatgatggaaaataccgggcagatccacaggacaataaagaatatttttttgttgatgctatttgccttgggatcaatgttcgttgcgatcacgcataccagatgcaggatcagcatgatcaccggaagcccgaacactgcaaaagccttggatgagtagccgtccggttcgttgcctgtgctccaatgggttgcaacggaatctggaagctgcttccacaaaagcaatccgataaggatcgggagcagcgtcgcaatcgatgtgagtaatatcatttttttatgttgtctgatcatggtcatttcctccttttaattcagtgatccatagcatgatctcctcaagcacggtggtgttgagctcataatagatgaattttccttcccgctcgtcgcggatcaggtctgcctccttcaaaacggacaggtgccgggaaaccgccgcaccggaaatcgaaaaatggtcgccgatctcgcccgcagacagccgtgatttcttgagcagattaaggatttcgcgtcttgttggatcggcaagcgcgcgaagcgtatcctgcattcccaaacttatccctcctacgcttaacatttaacttaattgttaaatgtattataacataatacgcgtggtttgcaaggggaaattaaagtgttttttgtaattgctcccattcatgttttaataatcgatattctaagcgggttttcattttaccatcgtgccattcataatcaatatgctcggcttcttttattaacccgtttttctgcataaccctctcggagcccttattctctgccagacacccggttgtaactctgtacacattgtcttgtgtgaaggcatattccagaaccttcttcaatgcctccgaggtgtagccattcccccaatgcctcggatatgtaaaatagcccagatggacaagctttcctaccggagtgtcggcttcaaccgtatacccgatgctgccaacctgttcgtgcgtgtctttcagctccatgtgacagaaatagaatttccgctccggggatttcatgtcagacaggacttccgcgaaatcccgtctggcttcctcaacggaatacaactgtatgtcctgcagatagtacatggtctcggcatccattttcaatctgctgtatgcctcaaaatccttctctgtataatctcttaaaataatgctcatgtgtgataaagtaacacaactaaaataaagaaagacagcccactattccgtaaaataatggagtaatagagaaaacgttttttctatgctaaaataggcatataaagtagaatgacaatcaagatatacaagaaagcacttaaactctaccgtttgtcatgtaattgtatagcttacttgctagagtgcaaatgagtattttgataagatttatacacaaaatcaaaaggaggaacacatatggagttcgcagaaaaacttataacactacgcaaaagtagagaattaacacaggaacaactggctgagcagcttaatgtttcaagacaatctatttcaaaatgggaaagtgggcaggtcatacccgaagtagaaaagattgttgaactaagcaaagtattcgatgttaccgtggattatctgttaaaaccatcagagatagatgaattatcggttaaaacagaaattctggaacaacaacagaaacagatgttagttagggaacagaaacgcactcaaatttccaaaaatattatgtattcgattggaatttatttgattttttttgcggtctatttcattgggcatttctattttgaaatatggaatgcttctgtaattcttgcggaattactcattgcaaccgcgattgtagtttttgtttgggtaaggagtttttccgacaaatcataaagagatagaatttgtagcaaacccagccgagcctgtcaacggtcaagatgaacggcgcaaaagcgccgccgttgacagccccgcccgtctttgctgttcggtaatcaagagggcgacagcacaaaatgctgacgctctctgccattatttagaagggggattttccatgaccgaacacgaaaagtatcaagagcatatccggcatacacacgatgttttttgcaagaccgtcattcggcatgctgccatagacgcagcccgaagcatacgcagccgccgcaagcgggaactctcacttgaatatctgatagaagaaaagcactatccattcagtaccatagataagtattttgcggagcaagctgccatgaacagctatccttttttcgtctgcggtcagatggtgcttttggaaagtccagagcttgccacagctctgtccgcactatcacagatggaacaggaaatcattttcctatactacttccaacgatggacgcatagagagattgggcagagatatggacgggcaggcaacacaaccgggcggcggattcagatgattttgcggcagctacgggcaaagttggagggcttgtcctatgagccagctacttccctatgaaacaatcgttaaggcaagcgagggcgacccggaagctgttgccgccgttctatcccattatgccggatatatccgctcttgtgcgaaaatggacggataattggtgcctgacacaataaacacaggtatagctttaaactatgacaaaccgccaaagaaaggtattatacaaataaactctgagatggtaggataacctcagcaaaacaaacagacaaaaaccagaaaagaaacaggaggttatcggataaatgagcacattaaagacaccatttcgttatgattttgtaggaagttttttaagaccggaaaaattaaaagctgcaaagaaagcttttgaggaaggaaccatcacaaaggaagaactcgaccgcatcaccgatgagtgcgtgacagaaatcgttgcaaagcagaaagcagcaggcttccatgcgatcaccgatggagagttccgcagaaaattctggcacctggattttatgtggggatttgaaggcgttgcccacgagaaagatggcggcggtgtacagtttaacggagagatggcagatcttgaagcaacttatctcgtaggaaaggtaaaagcaaaagtacatccgtttgtagaatactttaagtttttaaagcagttcgaagatgagcagaccgttgcaaaatatacgattccggcaccggcacagatgtatcagcagatgatcgttccgcagaacattgagcagacaagaaaattttatgcaaccgatgaggaactgatcgaggatatcggaaaggcatatcaggatgtaatcaaacagttttatgcagccggatgccgcaatctgcagctggatgactgcacctggggcgcaattgtcggagatgccgcaaagcagagatatcagtcactcggggttgatattgaagaggtaaaggctcggctcttaaaggtgaataaccttgcactcgaaaacagaccggaggatatggtgatcacttcccacatctgccgcggaaattatcattctacattctttaccagtggcccatacgactccgtggcagattacgtgtttgcgcaggagcatgtggatgcactgcttttggagtatgacgatgaaagatccggtggttttgcaccgcttgcaaaggtgtctccggacaaaaaagttgtacttggtctgatcacaaccaaaaagccggaactggaagataaggataaggtgatcgcaagaattcatgaagcagcaaagtatattccgctggatcgtctgtgcctgagtccgcagtgtggatttgcatcctgtgagatcggaaacaagctgaccgaagagcagcagtgggcaaaacttgcacttgtgaaggaaatcgcggaagaagtgtggaaataaaaccgaaaaaaataggtgagaaatttttttaccggttactgtttacagggaaacctgtggatggtaaccggttttctgttaatgataggaaacaaaatcaaagaaggcaaaaaaataagaaattgttgtaaaataaaaacctgaagctggcacttcaggttttttaaataatatgtcatagagttagcataaaagaccgtaaaatatattacagaccaagtgaaaataaatctgcggttacactttggctggaataaaatataaaaagtgctaacaccttccgcaattggtacatggcacacatccccggtgcataagctttggacgccagtcggaaatctgtgtgtcatccccggatttccaatgtccggtatgataacggtcggacacggtcagtgtcgcgtgttcctgccggattacaagtggatataatgtaatctgctccggctgcatacagttttgatgcagtaccggagcatagttatgtccatttacggtaatctgctgatcgtaggttacgatctcacagatatcatttttttgtgtaattgtgggtgtttttgcacatacatattgttttggaatttcataagtgcctatcgtgaaagttccggcaatcgtttttatgttctgcatgatggcaggcctctttactattttataatcccttgtattatagtattaaaattgaataactgtaaaggaaaattttttatatttttttagaattgctttgggatctgttaagttttgtcctccatacttacagacgcatttagaaatgaaaacatctggagaaggtggcattttaaaacgttatctgctatgataaataaaaataatgaaacgcacaaaaccgtggaaaatgggtagaactatgcaaaaacaggttggaattggcaaacaggattttgcagcattaagagaaagtcagtgcttctacattgataagacagatttcatacggcagtggtggaactacagggatgatgttacgctgatcacacgtccaagacgttttggcaaaacccttaatatgagtatgctcaactgcttttttcccaataaatatgcagacaggggagatttgtttaaaggacttgatatctggaaagattccgggtaccggcagattcagggcacatatcctgttttatatctcagttttgcatcggtaaaagcggataatgtatctgatgcaaaaaaacaggtcaaatcccggattgtaagtctgtatcaggattttgaatatctgctcgaaaatgaaaaacttatggaatccgaaaaaatggcataccggcacattctgacagagatggcggaaatggatgatattaccgcgtgtgacagtcttaattatttgtgcagatatttggagcatgcatatgaaaaaaaagtaattatcttactggatgaatacgatacgccgatgcaggaagcgaatgtttacggttattgggaagaaatgacttcttttttgcgtaatctgtttcatgcgacatttaagacaaataagtattgtatagatggtttaccaaatcgaaattgaccgaactgaaggtgaagaatgcttcttgtctaaagggcaagaagatggggattagaaagtgttttttacaaggaggtgattaggtgaatgatcaattcatacaaggagtaatatttgattgggataaaattgataaggatagttatctgaagggaatcagggcttttaagggagttgaaaaacttgattttaacaaaccaattactttttttgtaggggaaaatggcagcggtaaatcaactttattggaagcacttgccgtagcacatggttttaatcctgagggtggaacgaagaattatgttttttctacgcatgatacacattcagagttgtgtgatgcgataagaattgctaaaggctatcggaaggaaaagtggggatattttcttagggcagaaagcttttataatgttgcaacgcaggaagaagaatatgcagatattacacatccttccgctaaatatcatgaaaaatcacatggagagagttttctcgcattagcacagagcaatatgaatccaaatggcttgtatctttttgacgagccggaagctgcattatcgccgcagagacagcttacattgttgatgcaaatatacagatgtgcaaaagagggagcacagtttattatagttacgcattcgccaattttgttaggaataccagatgcagatatctattgttttgataatggacgcatacatctgtgcgaatatgaggatacagagagttaccaggtaacagaaatgtttataaataataggcagatgctgttggatagattactaacagattagataataaagaaatcgataaattcaagtttgtaaggaacagaaactttgaatttgtaggtgcgattgatgaagattattgaagttaaagaaaataaaaaacaatatcttgatttgctcctattagcagatgagcaggaaaatatgatagaccgataccttgataaaggtaaaatgtatgtgcttgatgataatgggattaaatgcgagtgcatcgttaccgatgaaggaagtgatgtgcttgaaatcaagaacattgcaactgttccagactatcaaggcaaaggttatgcaaaatccttaattgattttattgtagagaaatatagagagcaatatgctattctacaagtaggaacaggtgatagcccattgacaataccattttatgaaaagtgtgggtttgtccgttcgcatatcataccaaatttctttacagataattacgaccatccaatatatgaggatggagtacagttggtggatatggtgtatctgcaaaggccgttataaagaaattttcagtaatacgctctgttgatgtgatgatttttctacgatatactccttcaaaaaggagtgtgctcttatgggtagagaaatttatgacatcatcaatgacatggcagaagtattaaatgcatcgcagatgcagaaactacaagaggtgttggtaaaacggttatctaaaaatactgtatatgattatttgcagacaacaaatatggactttccagatatgcttttaactgcaaagcatttagaagggtgttctgacaaaacaatacgctattataggcgtaatattgaaaagatgttggatacaataaatattccggtcataaagataacgaccgagatgctacgaaaatatcttgtagagtatcaaacgataaataattgtggaaaggtaactattgataatattcgtagaagtctttccacatttttttcgtggctagaggaagaggattatattataaaaagcccaatgaaaagaattcataaggtaaagactgccgttattgtaaaagataccattccggatgagaaaatagaaatttttagagataattgtaataatctgcgtgatagggcaatgattgattttctgctttcaacaggaattagagtagcgaattggtaaggctgaacattgatgatatagatttctctgagcgggaatgcgtggtttatggcaaaggagacaaagagaggaaagcatattttgatgctaagaccaaaattcatttgttgaattatattgaatcaaggacagctaataatatagcgttatttgtgtcgttaaacaaaccacacagtagacttactgaaagcggtgtggagttacgattacgagaaatggggaagaagttaggtgtagaaaaggtacacccacataagttcagaaggactatggccaccagagcaattgagaaaggtatgccgattgaacaggtacagaaaattctgggacatgagcaaatagatacaacgctcagatatgcaatggttaatcaaaacaatgtgaagctatcgcatcgaaaatatatttcatagattgacttgtaacgcaaaagacgttacaataaaagaaagatggaggtgtattctatgggaaaaacagcaacattaaatataagagtaaatccagatgtaaaagaaaatgcagaaagtgtattggcacaattagggataccaatggctactgctatagatatgtatttaaaacaaatatcattagtaggaggaattcccttttctattgtattaccaaaagcagctaattcagtgaatgcagatatgatgtctgctacacagattcatcaaaagttagaaaaaggatatgccgatatagagaaaggaaatgttgaggatgcagctagtgcgtttgtggcatttagagagaggcattaatgaagcaatataatcgcattgctgatgaaatacttacattagacactttcccggaacgatttaggattatggattctgagccggaaaagagaatggagttgcgtagaatgctcgtcgataattattcagtgttttacacaatccgtgacgaaagggtaattgtaacggatgtgttatacacggcatctgatatagaagcacgtttgagaggcgagctataaaagcacgcgtttatttgaatttgtgaaggaactgatattatgaaagtgactattgaagaactggaagcatatttgcttgaccattacagtaatggtggaatcgaccaaagtttatttatgaaactcgtagaagaaatcggtgaagtagccgaagtcctaaataaaaaagcgggaagaaaaaaatctggtagtgaggatttgcaagctcaactgggtaatgaactggcggatgtgatacattacgctattgctattgctgctttgaatgatctagatatgaatcaaatcattatcgaaaaggataaagccgcttctgtgaaatacaatcatagaaccaatttggaacagttcattgttgatatgagaaataaagaattggataactaaccttcagtcttgtggagagattgaaagcaacagaagatcagaatttgtaaaggagatatacaacatgaagaaagtctgcttagcggttttgccagctttaacaatagtgttagaattattacccttgggagcagtttgtatttttgcaacatctccaacagaaagagtaaaagaaacattctcatactttagccttacaccgtttggctatgcaaattttgctccacttattacagccacacttactgttgccatcttcttactttcattgttttcattgaagaagaaaggtgttctcaaagcattgtttgtcctttccattattacggtagttatttctcttttgccattgatgtatggcttaaactactatacccttgtaggagcctttataacagtaacacttgtaatagaaagtattttggctaagatacaataaaagtaaagcgataactttcaggttgtcggattgtaaaggcagagccttacgcaaggtgcaggagaaagactccgctcgggttaagggcgaagcgccttagcaggtcaagggtgcaaccattgcccagttagtggcgtttcgccactaagtactgggtattacttgtagcagagcttcacaagttttggcaacttcgttgctgttcccttcgggaaaataattaaatattgttgttattaacagactgagtagagaaatttacttggtctttttttgtagaaaagaaaggaaagatatgaatgaaagcaactagacataatggaagatcaggtaagcattgaaagaatgtcccaaagcctttatttttaaaaacaaattttgttggagcggatccggaaaaaattaaaatggttaccagcgtgtttaggcgtacaatcgcctgaaaccggatggagagatagaaaaaagtcgaatgggtgtaagtttacgttgacaactaaaacaacatggtgtatatatgtatatatacacatacacagacggaacaaaactttgcacgaatgaaaatacgaggtaaaggcatggaacagacaatgatcaaaaccgagaacgtatccaagagattcggttcatttgcattacaggacatccattttgaacttccggcaggttatatctgcggactgatcggggagaatggtgtggggaaaaccacactgttaaacattctggcgggactttatgagtacgatggaacgatttctatacaggagaaggagtaccgtacaaatcagatggaattacagcaggatattggatttgtgtttcatgaggaatggttcgatgactgggattctctgatcgcaaacagcagacattatggaaaatattataaaaattatgatgagacactgttaaaggaatatcttaagagattccggttggatggaaagaaaaaatataagaaactgtccaagggagaaaagctgaagtttgcatttgcttttgcactggcgcatcatccgaaactgttgctgctcgatgagccgggggcgaattttgatcagaccttccgtgaagaattccatcatattttaagagaatttaccgcggacggaacgaagagtgtgatcctctcgacacatattacttcggatgtggaccggtttgcggactatctgctgttgcttaagaaaggcagacaactgttgtatggagatatcgagtcggtccgtgatgcataccggatggtggcaggcgagcgtcatgcgttgagggcttttggcgggcggctggtctatatggaggagacaccggtgggctgcagtgctctggtcaaacatgatcacgcggagtatgaccgggcacttaaggtgtgggagccggacacggaggaactgatgtattatctggcgaaaggagcggagcatggaagaggcaatcaaatataagaatgtgatcagagaatattttctggaatataagaaccgtgatcaggtattgaaaagtatcttttatgtgatcctgtttggcgcatcgtttttgccttttgtatttggcagtgcaaaggaagggcttgggtatatatggctcatatttccgatggctcttgcgctgtttgcagcaatcacacatacgagtgccatgccgacgatgctgtatctggttcccggatcgaaaaagctgcgcgaggaatatatccggagaatgttaaaggttaagattggcctgccgcttgcgttgtgtgcggtaatcgatatcatcctgctgatcgtgcagccgatgatgataaaaggcgtgatcctgcagctggtaacggtgttctttatgtcctattgtgtgggaattacaaacgacggactggtttggcggaataatgcgtcgcgggcagcttatgggcaggtaagttattttaacggaccgatcacggtattcagtgtgatcgcaagctgcgtgatgattggcatctgttcttcggagattacgaatgtggaattttgggttgcgcttgttatttatctcatcatttacgcacctctttcttatgcgcttcacaagcgttggggtggaatcagagagaaactcgccgtctatgaacttgcaacgaaggaggagacatgggactggtaatcgtcattgaaccgcatggaacgtatgccatctacgagcagatcgtcaatcagatcaagaatcagatcatatccggtgaactgcagccggacgaggcgctgccgtccattcggggactggcagcggatatcggcgtcagcgtgatcacgacgaagcacgcgtatgaggaactggagcgggagggactgatccgttccgtttccaataaaggattttatgtgtgcaaatacaacacggattatctgcacgaaaagcagctgatggaattggaaaaacgcctgcaggagtggattacgcttgcaaaacaggcgggacttggaactgaagatattcgtgagatgctggagggattgctgtaagatggaagatattattttttctgcgaagcaggtacaggggaagaaagcgttattcggcaaaggcaggttcgctttgcaaaatgtggattttgaacttccaagtggatatattatgggaatcatcggggaaaacggtgccggaaagacgacattcttccgctatattatggaggaaaagaagcattatcgcggcagcttttatctggacggaaccgatatcgcggaagatcatgcgtggtcgatgaaccggatcggatttgtctctgaggagcggttgtttttgcggcagaagagtgcaagagagaatgcaaggatgctgggcagcttctatgatacctttgatatggatcagtttgctgcgttgatggaacagatggatcttaccacggcacggaccgtggagaagatgtcgcgcggtgagaatatgaagtttcagcttgcatttgcactagcacacaaaccgaggcttcttcttttagatgagccgactgcggggatggatccgatcttccgcaaagaattttacaggttgctccggcagcagttggaagtgctggactgttccgtgatcatgtcgtcgcacttagaggatgacatccggaaagaatttgattatatcggacagtttgagcatggggaatttacttcgttttatgagaatgcataaggcgttgtggcagtgaaggttatgcggtgagacggcaatggttgagtgaagtgcagaaaaatgtgcttgaatcgaaacacatgggtattatgtgtaaaagacaggagtgtcgaggatgacgatagaggataagaagcaacaggaaaatttgaagaattttgaccggaatttaaaggagagcacggatcagctggcatggtttttatactggatgtttgcagctgttgtgctagtgttagggatgacgctgatttttgatggaatattttatcgggatgcgtggctgatactgtgctatgtgtggatggtcgtttttatggataactatgtattggcaccgtatcaatggagcaatgaagccttcagccggaggatgcaaaaatcggatgcggtttcaaaaatacttcggtttgttccggtttcgggaaaaaactacttccgtgtgaggatgcagtatctttggaagtttgtgtggaaatttggcgcatttgccatgctgatcgtgatcggaagcatgagttttacgcaaaaaatttctcttgtgagggtgatggaaggtgttcttttatttttggccggaccgatgctcattgggtatgttgagttgaaggaatcacttttttgcagataatgcctaaaagaacaaagtgcctgacacaataaacatcatataatatgctgaattccctcacagatcctgcgggcaaccaccggattgttcatggtatacaggtgaattccatcggtatcgtttgccagcagatcaatgatctggcttaacgcatacgacatacccgcatcaaataaagctgccttgttatcttcaaatctatgaataatcttctggaaacgttccgggaaagaagctccgcacatcgtaatcattcgcttgatctgcgcggcattgatgaccggcatgatgccaggaacaattggcacattgatatccgcaatccggcagtcctccacaaaacggtaaaactgtgtgttgtcaaaaaacaactgggaaagcagcacttctgctccggcatttaccttttccttcaggtggcggatctcttcaatcttattggcagattccggatgacattccgggtagcaggcacctaaaaagcagaaatcccccttcggtttcagataggaaatgaggtcggatgcatgcttaaaatcatctttttcggtaagatccggatttcggtctccgcgcagtgccagcacattctggatgccttctgcggtaaggattctggcaaattcatcaatttctgcccggttgtaatgcagacaggtcaggtgcacaaccggctccacatggtagttctgcttaatctttttggcaagttcaatcgtgcggttacagtttaagctgccgcccgcaccaaacgtcacgctgataaaatccggctgcagttcgcacagcacatcaagtgtcgcatcaatatttttcagttcactgtcctttttcggaggaaatatctcaaaagataagctttttttatgattacatgcgtcagaaattttcattttaataccgtctttcgttcaaaattattgtaattactctgattatagcaggaaaaaataaaactgtataatacataaatgatgcatttctccatagattcaggctatagcaggaaaaatcagcgatacgattggaatcagcacggcgcgggtagcagttcttttaagaaaaatggagtccaaagatctgattggaaaagaaaaaagaacacatagttttacagataataaacataataaaattacagcgtaaaaatgcaacaattcttataagaatgttgcatttttatttacaccttttatatcggatggcatttctggaacttaaccccaaaaataaaaaatttcaaatttctgcttacagatctattttcaaatagacagaatccttttcatcctgctcaattccaagatagcgtttggtgacatcataggaagagtgattgaacaaacccataagcagtgcgggctgtgctccctgtttccatgcgtggtagccaaacgttttccgcatggagtgacagctgaccatgcggctgtttgtagtttgggctgcggcttcttttacaatgcggtatgcctgcgaacggttgatgggatgctgccggtcagtgtttttgcaaaacagataatcacattcctgtggaaaacaggcatccatataccatcgtagggcattcttggcatttttgttgagtgcaatgtaattttgttttccggttttctgttccagtataagcagatgttcacggaaacgctgcgtgtaaaaatcatagacatcgaaccattgcagctgtaaaaggtcactgatgcgcaatgccgtattaagaccgaggataatcagggcatagttgcgggggtgtggtttgaccgtctggtagtatgtgctgaatttttgcaattccttgcgatttcgaatcggttgtgtagtacccattttgtaactcctttcatggaagtcggattcttgagtgatagtacagaaatgcatggtaatccgtatatatccccacgtcaagatgtaacattcttataaggagagttgcatcctctggatgaaggggaataaacatggaggttcttatgctgaaactgagcttgaaaccgggcgaatacattacattgggagataacattaaaattattttctctggaggctctgccaacaacatacatctgctggtggatgcaccgcgcgaaataaatgttgccagaaacagtgcgggcaaagacaaaaagccatcaccttattataaagaaaaaggaatttcaaaaacagcacagcgtgagattgcagaaatcctcatgcgcgaaaagcgcaaccagtcgcatgtcagcggggaggagaccgtgacatacaaaaaacggtaataagcaaggcgatcctgggggctttgcatattataaatttcaaatcaatttgtggttcgcgtggcaggatgccgggaaccacatcacattccgtcggaacggattccgcggaacacacacatggaggtaaaattttatgagtatggtagtacaacacaacatgcaggcagccaatgccaacagaatgttaggagttacaacaagcgcacagtccaagtcaaccgagaagttatcttccggttacaagatcaaccgtgccgcagatgatgcagcaggactttccatttccgagaagatgagaaagcagatccgtggactggataaggcttcttctaatgcacaggacggtgtatctgcagtgcagacagcagaaggtgcactgacagaagtgcattctatgttacagcgtatgaatgagctggcaacacaggctgcgaatggaaccaacagtgatacagatcgtagctctattcaggacgaaattgagcagcttactacagagattgaccgtgtttctgagacaactaagttcaatgagacatatctgttaaagggtaatgtggatggaacttcttcagatgtaaaggttgcagcacatgatgccggtcttgctggaaaacttacagataagggaaatggtacaacggtatttaatcttgataaggagcttgctaatggcgataaggtaacaatcgctggtaagcagtatacaattggaacaactggtaaaggttctgttgctgatccaagcactttgaatacaaaaacagatggatatgcaaaaaaggatgtagtaccttttgatgcaacaaccacgttaaacgtaggagatagcgttacatatgcaggaagcacatacacattaacggataaaacagctgtagatcagttggcggcagctgatgagtttaaaatcggtgacgtgggatataaaattgtcgcagataacgcagcaactgtaaatactggagaaattaagcttacagatgctaaaaatgagattactaaggctttggcagatggtaaacaggtagcttctacaaaattagatggtgcaactgcaaataaaacaattgttactgaacttgaaaagggtgaagttagtacaacggggcttgctgatactaaggcagcaacaattgcagcaaaaggtagtggaattacaggtgcaacaattggtgtaggcgatagtgttactattagtggaaaaactactgtcgcaacggaagaaacaccgaaaagtgctaaagatatttatgatgcgattaaacaaacgacagaaacaacaattacagttggatcaggtgttgatgcaaagacatacacgattgtcgaaaatgacgaaaatgaagatgcgtcaacctttaaagcaactaaagatactattctctcaacaataaaagatggtgataaagtaacaattggtactacaagtaatacagtcattggtgatatcggctctacaggtactgacggagatgtaatcactgcaaagcaggcatatgcaaagatggctgatgagttacagaaagcttccagcattggaacagataccgctgcaaaggttacaaatgacggaaaaggtaagttcacaattcagcagggaacggtatctgttaaagatagcctttcattcagcttacatgttggtgctgatgctgatatgacaaacaagatcacagttgacgtagaatctatgagtgcagcaggactcggaatcaagggcttaaatgtcaatgatgataatggtacagctgcaacctatgcaattgattctattgcagatgcaatctctaaagtttcggctcagagatctgcacttggtgcagttcagaaccgcttagagcacaccattgataacctggataacgtatccgagaatacatcttctgctgagtctcgtatccgtgatacagatatggcaaaagagatggttaactacagcaagaacaacattcttgcacaggctggacagtctatgcttgcacaggctaatcagtctaaccagggtgtactttctctgttacagtaatttttgtaaaatttataattgctaaagaaaaggagtcgggcaaccggctcctttttgtaatgttttataatgaacgaaagtctgttgaagaacaaaagtaggacttaattgccgtgattttgtattgcgactgatgaaaaagggtgattttttgtttggggacatatagaaaattttgctctgttatgtcccactcttttggcacggtgggacatatagaatcattcctttgtattatgtcccatatgtctgtggcaatgggacatatagcgttttttctggcatatatgtcccgggaaacaaaagaaaagggacatagtgagtaagttttcatgcatatgacccagtgagcaaaagaaaagggacatagccgataagtttccatgcatatgtcccacaagcaaaagaaaagggacatagccgataagtttccgtgcatatgtcccagcgagcaaaagaagagggacatagccgataagtttccgtgcatatgtcccacaagaaaaaagaagagggacatagccaataagtttttatacatatgtcccgaaagagagaagaaaaaaattcagtcagcagattttcacacatatgccaatatccagaaggcaatgtgcataaaaaatcccgccacagagggaggaaaagatattctgtggcggatctataagaaaaatcgctttcgcgaattgtttttagtcggaactgacagcaccccaacaccgtttgttaaaatacaacagccccttttgttttggtggttttatattaccagtgcattatgaacaggttgtgacaacatgctaaagagtttatgaaaattcgaaacaacttataaacttaggcataaatttctcagcatggttcctgggcagcaggcgattttttaagggttccccagatatgtcgattcatggacatctagtgtgtgattgcttatacaaagacttttctgtgcaaatccggagatatccgaacattaaaatttccctgtccgaacaagcctcttaaatcaatgtaagtcgagaattacaatgaaaagattggagcagttagtggacaataacaaacaattaacttttcaataagctgtggataggttatactattcatagcttatttttgtggaaaagaaggggggcttctatggcaaacagtttaaaattaccggttggaattgaaaattttgaagaaatccgaaagtttggattttattacatggataaaacaaagcttatagaacaactggtggaaaccggaggcaaagtaactctttttacccgtccccgccgctttggaaaaacattaaatatgagtatgctgcgggctttttttgaggcaggcgcggatacgacattgtttgacgggttatatattgcgggaaacaaggaaatttgcgaacaatatatgggaaaatacccggtcatatttctttcactcaagagtgtggaaggattatcttatgaggatgcaaggtatcgtatcacagagctggcaggaagagaggcacaacgtttttcatttttgtcagagagtgacaaactatctgataatgaaaaggagcagtatcaggcaattgtcgcattgcataatggcaaatattctatggatgagaatatactgacatcaagcatatatatactgtcacatttattgcataggcattatggacaaaaaaccgtaatcctcatagatgaatatgatgttccactggataaagcgtttcagaatggctattatcgggagatggtttcactcattaggggacttttcggaatggctttaaagaccaatgatagtctgcagtttgccgttttaacaggatgcttgcgtatttccaaagaaagtatttttacaggatttaacaatttcgaggttttgtcggttttaaatgttccgtatgatgagagttttggatttacggacaatgaggttgaaaaacttctggatgattacacgttttcagaccactatccggaagttaaggagtggtacgatggttatcatttcggaaacactgatatttactgtccttgggatgttatccggtattgtaaaagcctgtgtgcagatccgaacgcaatgccagaagatttctggtcgaattcaagcggcaatgccattgtgcgcagatttatagacaaagcggatgtccagaccaaaaacgaaatcgagcgtctgattgcaggagaatgcattgaaaaagaaatctcgctggaactcacatatgatgagcttgataaaagcattgaaaatctgtggagcgtactttttactaccggatatctgacgcatcagggacgtacagaaagcggaaaataccgcctgactattccaaacagggaaattaaaaacctttttataaagaaaattagggaatggttcagcgatgtgtccaggaatgacggtaaaaaactggaagaattcagcaatgcatttttggaaaaaaatccggaaaaaattgagcagatctttggagattatctgtggaacacgatcagcataagagacacagcggttgcaaaagaaaagaaagaaaatttctatcatggcattctgcttggtctgctgggctataaagcaacctggcttacaaagtcaaatgccgagtccggaaccggctacagtgatattttggttgaggtgccggacaaccggacaggaatcgtaatcgaactcaaatatgcagaaaatggagatatggatgcggcatgtgccaaagcactggagcagatagaggaaaaagactatgtggataggctgagacaggacggaatgaggaactttattaagtatggaattgcgtgctttaagaaggattgtaaggttgtggttggagaataacaaaaatctctttacaaaccgcagaagatatgctagatttttatacaagctgattgtcccgtttgtttctgcaaccggaaatgggggcatatgttacacataaaaaagaacttcttaaagtcagcattggctgtcttctgcatggtttccatgcttttattctccagttacaacggaatcacaacagtatatgctgccagcggatacgaatacgttctgctgacaaaatacagtaagaccatgaaaattggagacgagtattatctgactgcgattacttctaccggaaagaaaccaaagttttcttcgagtgattccacagtcgcgtccgtgaacacttatggaaagatcacggcgaaaaaggccggtaatgctacgatcactgcaaaaattgccaatggggaggcaagctgcagggttacagttgaaaaaacggtcattacattaagtcagaaatccatatccttggagaacggatatatggcccggctgaaagccgagacatcaaccgggcatccggtcacgtacaaatccgcccgctcgagcatcgcctcggtggatgaaaacggcgtgatcacagcgaaaaaaccgggtgaaactaccatcacggtcacggcagataaaacctcccagacctgtaaagtgacggtaaagcagccaacggtccggctggaccggacattcgcatccctttaccggaaggggacgctccggttatccgtttcttccacatccaaaagtattcccaggtggaaaacaaataaaaaaagcgtagccacggtggacaatgagggcagagttaccgctgtaaaaaacggaaccgccatcatcacggtcacagtcgacggtgtcagcaaaacctgtgaggtcacggtaaagaagccaaagattaccgtcggacaggaacagatttcgttaacggccggcgaaacatgtcagccgaaggtaacggtatcctccggcaacaaaccggagtactacagttcaaacacaaatgttgccacggtaaatgagaccggtgtgatcaccgccatcggcaggggacgtgcatatatttatgcgaaagaagatggcacgaaggtacgcatgacagtaactgtcaaagaaaaataatactacaggaagcagaaccgaattatggtttgtatgacagacaatctgcggatcataaccaaagggacaatcagcgaaagatattgatgatgcatatatacaatgatataattgaaagaaatgatggagaatcggagaataatattatatggggaggaatgattatgctgagagtagattttacatttgacaaaaaaataatagagaaaaatggatatacaatgtcaaatatttatgaaactataaaaatggaatttggtaaaaaaaatatttcatgtgtggcagaaggggaagtcctttctttcggcgctggagaaaagaaaaacgatttttctgatatgtggacgattattatgcgcttgacacgttctaagtggtttttgaattatgcaacatcctgcacatggaacgaaaataataaaagtgaagatgttttagcgcaaataaagagaaaacagatgataagtgcataatatggaaaagctttcccaaaagctgccatggttatatctttgtatgaaggaggaaaaatgaattcggtagaaaattatgccatacgctacttagaaccaaaggatgtgaaggatctggatcagtacaacgcgctgctgcgctatacctttcaggtaacggaggatgagctgacggcaaccggatggaaagatgaagagatcaaacagtcgaagtttccggtactggagcgtgcggatgtgctgggatgttttgacggggataccctgatttctcagtttgccgtatatccattgaaaatgaatatatacggggaggtatttcccgttggatttgttacgagtgtttgtacatatccggaatataccgggcagggcattatgaaaaaactgatgtatcagagtctggaacatatgaaacagcagggaagatcgtttgccctcctgtatccatattccataccgctgtatcatcatctgggctgggagattatatccaataaaatttctttcaatatcaaggaccgtcagattccaacgaaagtaaaagcacccggatatgtacggcgtgtggactgggacaataccgattttcatgagctgcattcgcattttgcgtcgattacgcacggctgtctgttccggaatgcactggcgtgggaggaatactggcgctgggatgaggacgatacgaatgtggcagtttactataacaccaaggacaagccatgcggatttatggtctatctgatcaaaaacgatatcatgcatatcaaggaaatgatttacttaaaccgtgaggcgaaaaaagggctgtgggagtatatccacgcgcatgattccatgatcgatgcggtgcatggctatacctatttcagcgaaccgattgcgtttgagatggatgatggggatatcaaggaaacgatccggccgtatgccatgggacggattattgatatcgagagctttttacaggattatccatgtgatccggatggcggaacactgtatatcgaacttgaaattgaggatcacctgcttttgtggaacaaccgcagttttcggctctgtttttccgatggaacatgtatgctgaccgatgaaccggcagagtataagttaaaaatggagataggtacgctgactacccttttactgggatataaaacggctgagcgtctgtatgcccttgaacgcattgaaggaaagcaggaagcggtagaccgtctggatgatgtactgtttcataaaattccatatatttccgattacatctaaaaaattcagcatggtatgttataatggaaagtgaaaattaccgggataccgttctgcagataccggtactggatgattttcggaatacataaggggactacttataaaaacaacagaaaaaatgagtttgggaggcaaaggattatgaaatcagtacggacaaagcttatagcatctattttgatctgttctctttttacatcggtgctgatcggggtgattgcaatttcaaattctgtgcggacagccggaaaagatgcaatgaccatgatgcagcttaccgggcagaagaagaccgaagagatcaattccacgattcagaagattgagcagtcggtggatacgctcagtgaagttgcaatgagtaattttgactatgattcgttccggcagagcaaggattatgcggatacatacaccgagacggtacagcaggcggtgcttgattttgcaaaccatacaaatggggcagtgacggcatatctgcggtataatccggattactccaatccgacatccggtgtctttgcacagcgccagtcagttgacagtgaactgcagtgcctgacaccgacggatttttccatgtatgatgaaagcgatgtggagcatgtcggctggtattatcttccggtacaggcaaaggaagctatctggatgtcaccgtacatgaatgaaaatatcaatatttacatgatctcatacgttgtaccattgtttgcggaagacggaacatcgatcggtattgtcggtatggatattgatttttcacagattactgatctggtggatgagacaaccgtatatcagtccggctatgcattcctgacggatgcttccggttccatcatgcatcacaaaaatgtggatgagggtacagtcattaccgatctggacagctccttgaaaaagggtgcagattttctggcagaggatggcaatcaggggaaaaccttagagtatacttacaaaaatgtagacaagaagctggccttttataatctggacaatggcatgaagctggtgcttacggcaccggtgtcggagatttattccgaggcatacggacttgcaaagatgattattcttgcaatgattgttgcatttattctctcggcagtgattggtattgttatgggtaccggcttaacaaagccaatccgtcagctgacttctgtgattgagcagaccgctgcattggatttccgcccgacagaggctggagcaaagctgcggaagcagaaggatgaaatcggggatatggcaacaaagatccacgatatgcgaaagaagctccgggcgatgatggaaaacctgcagcagacgcagcaggttttggaaacaaataccggaaatttaaaccagcttatgaaacagaacagcgcttatgcggaggacaattcggcggctacgcaggaactggcagccgggatggaagagaccagtgcaaatgcggcgcacattgtggaaaacgttggaattatgagagaaagttccgacaatatccagcggcttgcagaggatggagagaaaaattccggacagattcaggagcgtgccggagagatggagcggatcagtacggagtcccgccacaagacagaccagatgtatgcggtcatgaaacagaagacggatgccgctgtggagcaggcgaaatccgtacagaagatcaatgcgctgacagacaacatcaaacagatttcttcccagacaaaccttctggcattaaatgccaatattgaggcagccagggctggcgaagcgggcaggggatttgcggttgttgcttccgaaatcggagatctggcaacgcagacactggataccgtttccacaattgacgagattgtaggagaggtcaacagttcggtttccaatatgaccgaatgcctcacaacgattatggaatttctggaacagaccgttcttggggattatgagcatttcgcacaggtgggggagcagtatcatgccgatgcggacacattccagcagatcatgcagcagacaaaagaagcagtggatgcattagagcagcacattggagagatctcttctaccgtatcagagatcaactccatggtggaacagtccacagatggaatcagcggtattgccgagaaatccggcagtacgcagaaccttgtaaccgagggttacgacaagctgcaggagtgcacacagtccgtcaatgtgatccgggattttgtcgcacagtttcatttggattgataattgtccgaagataagttaagacgtggttagtatagactaatatgaaaccctttaaatataggaaaaggaaattttacatcggaaacgaggaaaattataatgaagaaaatattaaaaccggaaaccacaaaaccacaatatgttgtgacaacagacattacttatgcgcaggttgattcctggttcggtcattgccggagagatctcaaactggatctcatctatccggaggacggggaaggaaagacatatccatgtattgtatggatttgcggtggcgcatggcagcgcatggacaaagcagcgcatctggcatatctgggcacactggcgcaggaagggtttgttgttgccagcgtagagtaccggacatccaacgagggaacgcatccgatgcagctgtgtgatatcaaggcagcaatccgatatcttcgtgcatatgcaaaaagatatcggattaacagtgaaaaatttggtgtgatgggagaatctgccggaggataccttacatgcatggcagcattggatcaggataaaaaactggatgtgggtgagtatctggagtattccagtcaggtacaggcagcctgtccatggtatccaccaacagatgcgtcccgttttccatataatgatgtggaaaaggcagccatgtctccggagtcacagttaatgggatttaatgtaatgacacatgcgcaggaagcttatgagaattccccggtttccaaagtgacaccggatgcgccgccatttttgctgattcacgggacaaaagacagtaccgtgcctttttcgcagagtgaggaattgtatgatgcgttagaagcagccggctgtgatgtgacattgcttgcgcttgatggtgcagagcatgcggacctgatgtttttccaggatgaagtatggcagcagatcattgcatttttcaagaggacattacaataagtgacctggcatctggataaggaaaggttcaaagagtaattggtatgaaaaagacagcagacaatattcgtataataggaaaatccgatggtccgacatccgtttttattgccggaaaaggcgaaaagaaatcgttaagacagaagatagaaaagaccatgtatgacttccggcgaaagcgtgtgatcaaattcctgagggcagatccgcacacggtggatgaggtggcagattatctggtcagggaactggggtataccgaagtaagtccatcggatgaaacataccagacagaatattccaatctgcgagtagcgtttctgttgcaatattgtccggaactgcttggagatctcacggagccccaaaggccgcagcagtgggatgaaaaaagtgcaatggagtttatgaagcaggtcgaacagagaaccgaggctgcgcgggcagttccaaagacagagtttgatattgattttcatctgtaccggaaaacaggccgggattttgagatgagtatatcaatagaaaaaatatatgaaagtttcagtggctccgcatccggctcgacgcgggtgatgcgcagatatggggcggatttccggaaggtgtaccggtattatggagtttcgcaggaggatatcaggcagcatacgaaacggtttgaggaagtggtaagacaactgacggtcaggtaaaatgagggcaatggggagtggttgaaggacatatacagaaaaagttcttgattatgtccttcttttttatctagctgggacatatatagaaaaaactgttttgtatgtcccgcaagacggcgctaatgggacataataaatgattttttgtctatatgtccccgtgctgatggagagggggacataacaaatgactttttctgtatatgtccgagcgctggagtagagggggacataacaagagagttttccgctatatgtcccagtgctagaggaaagagggacataacaagtgacttttttgtatatgtccagcgctagaatgcaaggctcggatacttaatgtaaacagtggacacaatgccgaactgatgaataagtgcagacggctgatgcattattctttgtttattgcaaggatacggcagaacattgacaggggaatgccgattgagcaggcaattgatgaatccatatcgtattgtatccggcatgacattttaaaggatgttttgctcaagaatcgaagcgaggtgcgccatatgctgttaacagaatttgatgaaaagaaatttgcaaagtccatgtggaaagaggggcatgagaaaaatttcaaaacggggatattccattcaaaaatggcattagttagagcgacctaaccaatgccattttttattttaatagcataaagcattaaaatcatcattaagtgatggattatgtaaaatttaaattatatcttccgggtttacattttacctgcacaatgtaatttttattgtatttcaaacaatgtaaatttatggattctccaagtttaatagttgtatcctttaaaacaattgtttggttctcatctagaatgcgtatggttatatcatagggattgtttatgtcatttattacttcttttttataaaaaacagatgaaaaaatcaaataatcaccgtcatttatgcgtacttgaaaccattcatccgaaccatggttgttatctatgaatgctatatccatgggcataaaaaagtcgtgaagtactcctacttcctgaatggcaaacatagcagtcattacaagaaacgcggtagaaataattgcagcaatcattttgatccggactttttttctgattttaaaaaatggagtcttactgtctccgacttcactaagtgggggacattcgatcggatctttcatggctgccagttcgttttgacatttgctgcaatgatttatatggtcttcaataagttttcggctgtcgtcagaacagacgtcatcaacatataatggcattaaatctcttacgatatcacatgttattttcatcttcaattacctttctgatctttgtttttgcacggaaatagttaacgcgcgcccaattttcacttttgtcaaaaatttctccgatttctttaaaactcatttcctcgtatgcacgcagccagaacacttgtccataagggtgctttacctgtcttaaagcagatagcaattttttggtttcttcttttatgagatacgtgtcctcaagattcctctgattgtttactgcttcaaaagattctaaatgttcgattccgactgtggttttatgtttctcttttttcagataatcaaaatataagtgttttgcaatctgacataaccagaccgaaattttacagtttccgttataacggtgcgctgatttgtatgcctgataaaaggtctcctgtgtcaggtcttctgccagatcaaaattgccgcataaggaaattaaaaaatgttttacggtatttgcatactccatgtacatcgtttcaagtggagtattcttttgcattttcctgtttcacctcctcgtattgcgcaatctatatataaatagaatttttgtttgttttgttacactttcattataaattattttttgaaaatgtgtcagaaacagatattgacacatgaaagcaaattgattataatcgtgtcaaaaacaaaagtggcacgggaggcatatgacaattacatcattgaaaagtgcattgcagcgaattgcgcaactggaacgggaaaacgaacagcttcgggcggaactcgaagtatataaaaaccgcaataccggcgggaggaaaaagcatgacgaagcatggatgacttcttaccgggattttgctgtaaaatatgagagtgggatgacaattatggaaattgctgcacagggggaaatcagccgtaggacagcgtaccggtataaagcttattacgatgagctgcagaaaaataaaggaaacatgcatgagtgaggggacaaaacgcaatatttctgttgtaaaagatgcagatggaaacaaaattgttgtgataaatgatattatatttaagggaaagaaaatagcctgggatgatgtcgaaaaatatctcagaaaatatgttggtgaggtttatagtattgcagaagataaagaaattgtttttataggaacagaattgccaggggaatatgcaggatctgtttacacgaaaaaattaagagggatgaatgcaaaggcaaaagcaaatgcagtacagattttaccggaaatgatagagatagcttctaatggtgtatttgaacataaccgcaaagcaaaacatgcgcgcgatacgaagatgggctggtatcggtatgatacgagatttgcattgccagtatataatgatcatggggaagtggacagatataatatctttacaggtcgattattgatacggcacgcttccagtggaaagaagtacctgtatgatgttctggaaataaaaaaagaaacgagcaagtcctgtcaggcataaaccctacccggtgaaaacccatttcttaatataaaaagaataaccctatttcattttacagtcaagtaatttttaaattttactgtatacagatgatcatttgttcctgttcacttagcatctaaacaggaaagatcatctggatagcagcaaaaaacacaacaaggagaaccaattgaatttactcgaaacattaaaacattattttggatacgacagcctgcggccgggacagaaggaactgatggacggaatcctgcagggaaaggatgtccttggcattatgccgacaggcgcggggaaatccctgtgttatcaggttccggcgctgatgcttgagggaattacgcttgtggtttccccactgatttcactcatgtcagatcaggtcaaggcattgaatcaggcaggtgtgcatgcagcctacatcaacagttccctgacggaaaaccagatacacgctgcgcttgcctatgcagcgcagggaaaatacaaaattatctatgtggcaccggagcggctcaacaccgcgcgttttctcgactttgcatattatgccgacatttccatggtgacagtggatgaggcacactgtatttcccagtggggacaggatttccggccgagctatcttgaaattgcagatttttttgcaaaactgccagaccgtccggttgtcagtgcatttaccgcgaccgccacagagcgcgtcaagcaggatattaccgcaagtttgcatttgcagaatcctgtgacagtcgtgacaggatttgaccgcccgaatctgttcttccgtgtggtcaaccgcaagggcggaaaagagacggacaacagtatcttaaattatgtgaaaaggcatgaggatgagagtggaatcatctattgtgccacgaaaaagaatgtggacagtgtgtatgcgcttttgctgcaatatggcattgcggcggggcgctatcatgcagttctgtctttagaggaacggaaaaagaatcaggatgattttacttatgacagaatccgtgtgatggttgcaaccaatgcatttggcatgggaatcgacaaatccaatgtgcgctatgtgcttcattacaatatgccgcagagtctggaatattattatcaggaagctggccgtgccgggcgcgacggggaagaagcggagtgtgtgttatttttctcgaaacaggatatcatgataaacaaacgcctgttgcagtacaaatccacatccgggcagacatccgatgatcccgtggtgcgggcaaatgagcagaggaaactcaatgagatgatccgttactgcgagaccgatgagtgtctgcgccagtttatcctgtcctatttcggggacaacagtccgtgtacctgtgaaaaatgcagcaattgtgtggtcgtggaagatgaggcggaagaaacttatatccaggccggaagagaaaagaaaaaggcattgcagcttgctgatctgacaccggaagggcaggaactgtttgagcagcttcgcaaatgccggacggaacttgccgtggaaaaaggtgtgccaccgtatattatctgttccgataagacattaaaagatatgtgtgtcaaatgtcctgtggattccaccgcgatggcagccgtgtacggaatgggtgcacagaaaatcgaaagttacggtgcgcgttttacacaggttatcacagcatttctgaacgagcatggtggagagactgccacagcggaggcattttccggcatgacagtagacaccacgacagcagctccggcaagaaaaaagaagctgccgttttatatcgctccggaaaaacttgatgaggtggaactgaccgacacctgtatgctttcagaactgacaaaccggatcaatgcgctctgcgaagagaacgatcgaaagaaactgaccgcttcatttatcaatcagctgcttgtggaaaaaggatatcttgaggaaaccgtgcagggagaagaaaagataaagcgtgtgacggaaaagggaagagccgtaggaatccgggaagaggagagacaggcaaaatacggaaggaattattatgcactgattcacactcgggagagccagcagataattttggaggaactggggaaatatttgttacagtttacgccagcagtataattgtcccctgctttgtgttatactaaaacaaaacgataaaggacaggactattctatgaaaaaaacaggaatcatgacagacagccacagtggcatcttagaaaacgaagcatctaagctggggattgccgtactgccaatgcctttttatattgatgaaaaattatatcgtgaaggggtggatatttccagagaggaattttatgaaatgcttcgtaaaggtgcggatgtggcaacatcccagccgtcaccggagagtgtgatgcatatgtggtcagccatgctgcaggaatatgaagaacttgtctatattccgatcagcagcggtctgagcggttcctgcatgacggcacaggcaatggcacaggaggagccgtatgccggaagagtatttgttgtagataatggacgcgtgtctacgccgatgcaccgttcggttctcgatgccgtggagcttgcagagaaaggataccgtgcacagaaaattaaagacattctcgaaaaaaacagacagcatatggtcatttatgtgggactcagcacgctgacatatctgaaaaagggtggccggatcagttctgttgcagctgtggcagcagatgtgctgaagattaagccggttatgaaatttggtgtgggaaagttagatgtctatcagaagtgccgtggaatgaaaaatgcgagaaaagcaatgatagacgcaatgaaaaaagaatttgagacgaattttaaggaggcttatgaagcaggaaaattatatcttatggctgcatcaagttctaccgcagaagtaacggaagagtggatacggcagatcaaagaaagctttccgggtatggatgtcatgtgcgataatctgtcgctggggctgtcctgtcatattggaccggacgggctgggaattgcctgctgtaacaaagcagaatagtattttagaaatttatccgtgcgataaaagcgttagagaaaatgatgcggttctttcagcagggaaaacgttcgcctgcagggagcatttttgtgggatatcaatatacccaccgcaaaaagtgatgggtatcgtaaccggtttatttgccccgtgatgcaaaaaagtcatcaattgccgcgtgcagtttctgaggatccatgctctttaataaataaccatccggttttaaagacataacattttttacggtttctgcatcattttttccagtcagaaatatgatcggaatatggtgaaattccggatcttcccggagcatctgcatgatctggctgccgtcaacgattggcatggcataatccaacagaatcagatccggggtgtttaaggtcaggtatttgatcgccattgcaccggagtttgccagtacaacctgataggtgtcttcaagcagtgccttgattttgcgcaggataataccggaatcatccacagccagaatcgtgcgttttttcagctgatagaaatcgttcatctgtgtgcagacattatcgaccatatcgcccaccgtaatcgggcgggtgaacacatccatgaccatctgctgtgggagggtctcccacagcagttccagttcatctatgtttcccataataaataccggagtcttgttttttatcgcctggtcaaccattacttttacgctgaccgctttttttaaaagctccgggcttgtgcagatcaggtaaccacttggtttttccgagatgacaatgctgctggcttctgctatcgttacaatttttactttgacattttgtttttcaaaagcaccttctaatgattgtgcgagataactttgttcctccatcaggatgagaaatgggctttttatttcgtgcataatgtctctccttctattgtaataaattgaccattgtatcagttaatttcataatttcttccatttccacatctgcaacgcagacacgcagctgttccatcaggtctttgagcttatccggtgtctgaaacgtctccatggtttccatggcatgatccacgccatccatgtcaaactgttctacacactgatgcatctgctcaagaacggtaatccagtcatcagaagaaacttcctttttgctgctttcgttatcttccacataaggacgcaggagggacttaagacttcggtatatggcaagcatcggtcctgttttttcttcaagtgcagcaagattttgtgcatttccatacatttccagttcctttgcagcttcggacagaccgggggcaccgatcagcaatgcggaactttttaatgcgtggacttcaatcgtataatcctttattaattgttcctttagacattgttcaatctttttggatttgctgtcgatggtgttgtaaaaaatctgtatgatctgttttaatgcttcctccgatccgcagtagggcagaccgttttcgaagcggaatcaggggtttcagaatatgaaaaaatagatctgcaggcatatgaaaaacaggcggataagctggtaaaacagctaaagaaatatcagaaagattatgagtatgtaacatttgaatccaatattcatggggatctacgaaaaacggatgcggaaaaaatccggaaatccttagaaaccgggacttaataaaatttttagaaattttattagcactcctacttgacgagtgctaataacgtgctataataggggcataaacaaagaacaaaacgtttacaggaggaaatgacttatgtacgatttatttgatacattttttaacccatggtatgacgatagtgaatataacaagaaagccccgaagcagcaggcatcgcaaaacacacagaatctgatgaagacagatatcagagaactggcagacggatatgagctgcagatggaactgcctggttataagaaagaagaagtgcaggcagcattgcacaaaggctatctgacgatcagtgcagccaagagtgcagaagagaccgtggaaggtaagtatctgcgccgcgagcgttataccggaagctgccagagatcattctatgtgggcgagtatctccgtcaggaagatatccgggcaagtttccagaacggtattcttaccctgtttgttccaaaggaagataagacaaagacagaagaaaagaaatatattaccattgcgtaatcctttataaatatcccctgatttttgagccgttgcaggtatttttcctgcggcggcttttttcgcgtcacaattcttttttccgaagaaacaaaactttatatacaggtatagaggcaagtggcaatgattgatgttgcttaatgatgaaaaaggcaatataataaatggattgagatgaaatgacacaggaaaaaagagagaattttatgtttacaaacgatacgattttttataaaaaactctggagtcttatgcttccgatgatgctgcagaacttgatgctggcactggttgccgtggcagatgcgtttatgctcggagggatggaccagaattacatgtcggcagtttcgcttgctacgcagattcagtttatccagaatatgcttctttctgctgcaaccggaggactggcgattctcggggcacagtactggggcaggggcaatatcaaaacgctggatgatattttctgtatggcactgcggctttgtggtctggtgtcgattgcatttttcattgcctgtatctgttttccacagtatctgatgctgttttttacggatgaaccggtattgatcggttatggcgtgcagtatctgcggattgccggattttcttatctgcttacaggaatttcccaatgctatctggtggttatgaaaatcagcgagcacgcattgacaacggcattgatcagttctgctacggtagggatcaatattgcactgaatgccattttgatctacggaaaactgggtattaccccgatgggtgtccggggtgcagcaacagcgacattaagtgcaaggatgatagaactggcctgttgtatcctgatttccagccgtccgggctacatccgtccgtatctgacccgtctgtttcaaagaaaccgggaactggcacgggatttctggaaatgcgcaatgccgattctcggtgcgtccctgttctggggagtcggatttacttcgtattcttcttttatgggacatctgggagtagacgcggccgctgccaattctgtggcggcggttgtccgtgatatcatctgctgcctgagtgccggaatttccggtgcggcggggattatggtcggaaatgagcttggtgccggcaacctaaaacggggaaaattatatggtacgcggatgatgaagatttcctttgtgtgcggagttgccatgatggttctcatgggaatttcggcaccgtttattttgcattttgtcaaactgacaccgcaggcagccgtatatttaaagggaatgtttgttgtgctctgcgtctatatgattggccgctccgtcaacgaaattaccatcaatggcgtgtttggttccggcggtgatacaatgtttgatgtgtacagccttgccgtaacaatgtggggaatcgcgattccacttgccgcgcttggaacttaccggttccactggccggtgattgtcgtatacgcgtgtacctgtattgatgaggttggaaaaattccgtggacactctatcattttcggaaatataagtgggtgaaggatctgacgcatacggggatggagcagaaagaaaaatcataaatttataaaacatcagctggtcgtatccctgcggatcagtaccggtgtaatctgtttatggatcggttccgaaagaggaaccggtcttctttttttgcgttcttccatctgctgtaccagaagttctattgcggttttggcgatcaggtcgatctgctgtccgaccgttgtgataggcagaattgcctcgcttgcaatcggggaattgtcaaatccgaccagttcataactgtcaggaaagcatccgtatttttggaaaatcaggtttaaaaacatatttgcataggtatcattggcgaggaaaatccccttttttttgcatggatacttctcatcaatatcagagaaaatgtgcttcatttgtgcaaaaatgtcctgataagaatcccctattacatttaaattcagttcataaggaacgtgatattcctgacaggtatcttcaaaggcacggatacggtcataggcagggatggactttggaacatccgcattaacgtgaatcagtacatcgcatttgtctcggatcagaagcgttgccgcctggagcgcacccatataattgtcgctggttacgccacagatatgttcggcttcgcgctcaatggcaatgaccgggatctggtaagaagccagtttttcagaagaaagagtgtgacttaacacgatcagaccctcaatctggtatgccatcagttcatcaatgtactgttcctcctcggacggtccgttgtcgctgacgaatacgagaaatttataatgaaaatcgcggtagctggaaagaatctgtgtaagcatttccgaataatagtgcagataaaggttcggaataatgattccgataaattcactctttccattggcaagaacctttgcaagcttattctttttgtaacccagagtatcaagagcctgtgaaattttctcctgattttcaagcgtcagggagtccggatgattaaaatatctggaaatggttgtctttgaaaaattcgtatatgctgcaatatctgcaaatgttacctgtttctttcccatctgaaagctgtctcctttatctgttttatccatagtataacaaccggaaagaaaaatagcaatgaaaaaataactagttacgtaatcggttactttaataaataaaagtgttgacatatcggaaactttgtagtactatcagaatataaagtaaccggttactttaccggttacaccaaagcagaacgagtaatacgatgaaaagggaggagcaatcgcatgaaaaaactggcaaaacaagtcggctctgcgaaaaaacaaaccatggggagtaagctgtcttatataaagaaaaactggcagctgtatgtttttttcctgatgccggcactgttactcacaatcattttcaagtatcttccgatgggaggacttctgattgcatttgaggattacaatgtcattaaaggagttttgggaagcccgtgggtggggctggaatatttccggagatttttatcatcaccggattttatgaactacctgctgaacacattaaagctgagtatctttggacttctctggagttttccgataccaattattctggcacttttactgaaccgtatccgcaaggcggggattaagaaaaaaatccagctgctgatctatgcaccgaattttatttccgtcattgtcctttgtggtatggtgcgtatgtttttatctccggtaggaccgttaaaccgcctgttggggatgaatacaaactggatgaccatgccgtccgcattccgtaccatttatattgcaagcggaatctggcagggagcaggctgggcatccatcatgtatactgcagcattatccaatgcaagcaaggaactggaagaggcagccattgtggacggtgcaaatcttttgcagcagatctggtatgtggaacttccggcaatcaaggatattatcgtgatccagtttattttacaggccggaaacattatgagcatcggctttgaaaaggcatatgccctgcagacagatatgaacttaccggcttctgaaattttatcaacctatgtataccggataggtcttttgaatggcgattacggttattctacggcagtgggactgtttaattcggtgatcaatgtgatcctgcttatatttgtgaactgggtggtaaagaaattaaacgatggagaaggattataggaggaacgtgaaatggaaacagttagtaaaatgaaatattcacggacagaccggctggtgcttggaatcggttatgccattcttggactgtttgttctttcaattgttgttccgctggtctatgttgttttagcatcttttatggacccaacggtattgaataatcagggactgagttttcacatcaaagactggacactggatgcataccggcgtgtgctggaaaacggaatgatctggcgcggatttttaaattcgtttttgtattcactggcatttgcggcaatttccgtatttgtcacattgttagcagcgtatccgatgtcgaaaaaagaatttgtcggaagaaaattttttaacgtgatttttctgatcaccatgtttttcggcggtggaatgatcccgacgtttattttgatcaatcagcttcatatggtaaataccgtatgggcaattctcattccgggagcatttaatgtctggaatatgattctggcaagaacgtactatcagtccattccaaaagaactgcgggaggcatccgcaattgacggggcaaatgagatccagcatttcttccggattatgatgccggtgtgcaaaccgattatcgcggtgctggcactgtggtcatttgtcggaatgtggaacagttattttgatgcgatgatttacttaaatgatgcaaacttacagccactgcagctggttctgcgttccattctggtgcagaatacaccgcagccgggcatgatcgcggacattcagagtaccgcggagatggcaaaagttgccgaacagttaaaatacgcaacaattgtagtatcaagtttaccattgcttattatgtatccatttttccagaaatactttgacaaaggtgttatggttggatcggtaaaaggttaagcagaaaggacaggtacagatatgtggaagagaaaaattaaaaaatgtctggcactcggactggcatttgctatgatgaccggcgtggcaggatgcggaaaagagcagcatctggaggcagagatcaatccggatataccggtttcagaagtgcagtttccactgaaagaacaggcagaattatcatttatcacaagtgctccggcaacctctacgcagaatccgaacgagcggattatttttaagagactcgaaaaacagacgaatgtacatattgactggacctgttttgtggcagaccagttttccgataaaaagaatctggcactggcacagtttggaaaccttccggatggtttgtttaatgcaggaatgagcgattatgatctgcttcgttatgcaaagcagggaattattattccgctggaaaatctgattgacaaatatatgccaaaccttcaggcggtctttgagaaatatccggaataccggacgatgtgtaccgcaccggacggacatatttattcatttccgtggattgagcagcttggcgcagggaaagaagccattcaggcaatcggggatattccttatatcaataaaaagtggctggattatctgggactggatattccaacgacaaccgatgaactggaacaggtgctgattgcgttccgggatcatgcggatgatctgaaaaaacagtttgatatcgagggagatgtgattccgatgtcatttatcatcaacaatggcgatcaggatccggcgattctcatcaacggatttggcgaaggatatggagatacgggcgatcattttgccgtaaaagatgacggaaccgtgatttatacgaccgtgcaggaaggttacaaagaaggcatcgaatggctgcataagctggtaacagaggatcttgtagatccggaggcatttacgcaggagtggtcaacctatgtggcaaaaggtaaaaatcaccgttacggtctctgctttacctgggatattgcaaatattgacaataataccgattatgtgatgcttccggcactgaccggtccggagggagccagaaatatcacaagacagaataacagtgaaacaagtggttttgacagaggccgctgtgtgcttacatccagctgtcggaacacggcactggcggcagcctggattgatcagatgtatgcgccgcttcagtccccgcagaataactggggaagttatggggaaaaggattcgtttaatatttttgaactgtccacaaataaagatggcggtgaaatgttgaagcatctggatctgggcgaccagtcaccggtagaggtacgtgaggcgcagtctgtcaacggtccgcttgcagttctcaatgagtattatgatgtgtatgtcacacagccggcggatgctaaatggcgtctggacaatatgcatgaaacatatctgaaggatatgaaaagcaagtatgtatatccgaatgtgtttatgagtattgacgataccaataaagtatcccagtatgataccgatattaaaaaatatgcggagcagaaaaaagcagactggattttaaatggcggaatcgacaaagagtgggattcctatttaaagaaaatggaaaaatacgggctttccgattatctggcaatcaaacagaaatatttcgatcagtatcaggagtcattgaaagaagaaaaataaacaggagaatttgtatgagtgagatgttaaaaaaagcgagagcatatgaggcagaaaaagcagcacagaccgataaaaataccagaccgttgtttcatatctcggcacctgccggatggatcaatgatccgaacggtttttccgtttacgatggaaaaatccatctgttctaccagtattatccatatgcaagggagtggggaccgatgcactgggggcacagtgtgacaacggatatgataagctgggaacagcttccggcagcacttgcaccggatcaggactatgaccggatcggatgtttttccggaagtgctattgaagcggataacaaacatgtgctggtctataccggtgtcacaaagattacactgccggacggcagggaagaggaacgacagaaccagtgcatcgcattcggggatggcagggattatgtaaagtatgaaaacaacccggttgtgacaggggagatgctgccggaaaactgcagccggattgatttccgtgacccgaaaatctggaaggaagaggacacctattatctgattgtcggaagcaaggataacaggcagatcggacaggtcgtgctctgttccagcaaagatttaaaagaatggaaatttgagaccgttcttgcagcaaacagtaccggaaaagtcggaacgatgtgggaatgtccggactttttcccactgggagataaacatgtactgatctgttccccacagaatatgaaagcggaaaaatacgaattccacaatggaaataattctgtttattttcttggaaattacgataaaaattcgcatatatttgaaaaagaagaaccgcatacgattgactacggactggacttttatgcacctcagaccacacttctcccggatgggcggcgtgtgatgattgcatggatgaagtcatgggatgcctgtgtggtgccggatacgcaggactggcagggcatgatgacccttccgcgggaactggaagtaaaagacggacagatctggcagcagccggtgcgggagattgcgcagtatcataagaatccatgtcattatgaacatgcagagattgatggtgagacagcactttccggcatttgtggacggacgatggatctgactgttacaatggatgaacaggattttaacgttttttccatacagcttgccgcagatgaggaatacgagacaagttttacttatcataagggaacgggaatattggagattgaccgcacatactgtggtgtgacaaaagatgtggtctgcgtgcgcaaaattaaaattgcagatccaaaaggacttaaaaaaatgcggtttattctggaccgtcagtccattgagctttttatcaatgacgggcagcaggtggcaacaacggcggtctgtacccctttggaggcagagggaatccgatttttcagcgataaaaagatgtatattacggtcgaaaagtatgatattgtattataaaaagtaacaggaggaagagaacatggacgtagtggctttgggggaactgctcattgattttaccgaaaacggagtcagcgggcagggcaatccgctgtttgaggcaaatccgggaggcgcaccgtgcaatgtgctggcaatgctgtcgcgcttaggacacaggacggcttttatcggaaaagtaggaaacgattttttcggaaagcagctggaagatgcgatcacggaagtcggtattgatgcagccggacttttaaaggatgacaaggtgcacacgacgctggcactggtgcatacgtatccggatggggatcgggatttttccttttaccgcaatccgggcgcggacatgatgctgacggaagaagaactgccggaggaaataatccgcggagcaaaaatctttcattttggaacgttgtccatgacgcatccgggtgtccgcgcagcaacgaaaaaagcgatcgcggtcgcaaaagaagcaggcgcgctcatttcctttgatccgaatatccgcaaaccgctctgggactccatggaagatgccagggaacaggtgttatatggtctgggacagtgtgatattttaaaaatatcggataatgaaatccagtggctgacgggtaaagaagattatacggatggagtccgctggatacgggaacgctatccggttccgctcatactggtttccatgggaaaagagggaagccgggcgtattataaagacagaattgtggaggcaaagccgtttcttcagccaaatacgattgagacaaccggtgcgggagatacgttctgtgcgtgtgtcctgcattatgtgctggagcatggactggaggggcttgaagagaaagatttgaaagagatgcttcgttttgccaatgcggcggcttctctgatcacgacgcgcaaaggcgcgctccgcgtgatgccggagaaagaagaaattgaaaaaatgctataagaaatgggagggcagtgccctcccgtttcttacaaagaaaatggttctatcttacatgtatgaatcctgcttttggtatcgtaattgattccgaccagtaaaaggtttccatgatactctttcaggctttcacaatattgtttttgtttaatctgcgtgattgcgccctgtgcactatgatcccattttaattcgataacaagtgctggtttatccggaaacttcttccgtggaagaaataccatatccgcaaatcccttaccgccggcaaattccctgtgtatcgtatagaaattgcgtgcggcatagagtgccagtgaaaccgtataacttaacgcattttcatcattatactggatatgtgatgtctcaaaatgcgcctgctgaatcccaagtgctacctgttctggccttccctgccagattgcctgcagggtgtctgctgaatttttcagggctttagagatttcgccccagtcggatacggaaacactgttaacgtattcttcacgcacttcattgtttggtatttttacagttttgttttcgtagtcatagctaagatagcccagatggattaaaagagtcaacacatcatcttcggtgcgaaaggttgtcatatcattggtaaaacttccggtattgacaggaacggattccccggctatcatactgagaacatcatcttttaatccttcaaaattcatatcgatataaatctgcagggcttcaaatgtttctgtttggttccagtaatttccaatttttccaaaacgcatgcagcttacaacagacctcggattatagatggatggtattttttcaaaagagtatccattataccatgcttttatttcatccagatccatatgataatctgtacaaagggcagcgacttccagttcggtaaagccgacataggatgcaagaggtcccggatttatcatggaaaattcatcaaacatatttaaagcggaatgggttccgtattttttgatcggaagaattcctgtcatataagcgagtgcaatacaggacttatcttttagcatatccctcaaaaaatccagatagatttcctgggcttctttatcctgtttgtattcccggaaaatacagtcccattcatcaatgattacgacaaaaggacagttagtttcctgatatacatcctgcatggattcaataagatctgtatcatcaaaataatcaacattcgggtattcccgttttaaatcccgcagtaccagccgtttcatgcgatcaagcagttcatagatgtttttcgtccggcttaaaaattcctgcatatttaaaaacagggtgttgtatttattacgataggtgtcaaaatccagattccgggcaattttatatggggaaaagagttcttttgcatcacagccacggctgtagtaggcagcaatcatgctggcggttattgatttcccaaaacggcggggacggctgatacatatatatttctgcagagtctgtaagacagaatttgtataggtcaataattctgtcttatccacgtagatatcagaatgtgtaatttcgtaaaatttttttccatcctggtttaaataatttcccatgcagtaccctcctctaattacacgtttgcccgtgtaaatgtatcatatcacaggaatgcctgcagactcaactatttccgcagaaacagcacacttacatactattatgcgattaaatatacaaaataacaggattatgtaaattataatctgatattctcttggaaaatctggaaaataccagtataattttcttaaatgaagatcggagaaggaaatcatgattaatcgggaagacatgctcgaactgacacggcgcatgactccggcgcggtcacacattgaccggatcgccggtgcatattatgatgcagaaggatatatagatggtacattcaacacgcattttttaaaactttccacagcagaaaaaacgaaaaatctggaactggcgaaggcagttttacaggcagagaccaacaaacagctgaaggattaccggattccggaaaccgcaagaaagccgggaagtatctggcagcttctggatggaatcaaagagtccgggctgcagaacgatgcgtttttggatctgctttatgaaatgatcggggaacatgttgcaccgggaaaagaaagttattgttttttgtttcatggaatgtatgatgttccagtgaaaggaaccgataaggaatggcaggaaggttccgaggaagtatataattatcttctgtgtgccgtgggacagcttgagggagaatatgagccggggctgccggaagcaggatttttatatccggctttccggcagagaagtacggcatgtaattatataaatctgtatgaaacagctgcttatcagaacctgtggaatctgttatggaaatagaaactacatacggaaacatttttgaagttctttatattcaccgagaacaagcaatgtggtaccagactggaatacggtatttggagaaattgccatattaattttgtcgtcttcccggatggcaacaatattgattccgaattttttccggatatccagttgaccgattgttttggaaatccagttttccggaacttccacttcaaaaattgcatgtgcctcatccacctgaatataatcgcgtatgtgatcggcagtataccgtatagcagcccactctgcaatctgtttttccggataaacaacttcgtctgcaccgtttcgcagaagaaattttttctgtacatcccgttctgcacgcgatacaaccgtttttgcaccgagttccttgagcagggaagtagtttcaagggaattctggaaatttccacctatcgttaccatacatacatcaaaattaccaatgccaagggattttaagaaatcggcattggtactgtcaccgatctgagcattggtgacaaacggaagaacctcattgacacgttcttcgttgttgtcgactgccatcacttcgtgaccgagatcgttcagctgtatggcaacatgtcttccaaatcttcctaatccaattaataatatatttttcatggtattttcaactcctttttaaccaactgttatcttttcgagcggcagttttactccattttgttttacggaaattgccgcataaattaaggtaagcccaccgactctgccgaaaaacatcagaaggatcagaatcagctgggacgggatgccgagagttggtgtaattccaagtgtaagtccgacggttccgacagcggatgccgtttcaaacaggcagtccagaagcggaaggtgttcgatggaactgatggcaatccctccaataaagaaaaaaatgatatataaagcaacgatggtggccgcatttttaatggcatgactgtcaagccgccgaccgaaaatttcaatgtcctctttctggcggaacgtggcaaccatatttaaaataaggactgcaaaagttgttgttttcatgccgccggcagtagagccgggagatcctccgatcagcatcagaagaatcataacagattttgatgtcggtgtcattgctgtaagatctgcggtgttaaaaccggcagttcttgttgttacagactgaaacgtggaggccagcagtctggtgccggttgatgaacccgtaaaatccacaacaaaaaagaatacggccggaattataataagtaaagccgatgtccagagaatgactttgctctgtacgcgataacgtctgatatgccatttatgggtgcagatatcgtcccacgtcagaaagccgatgccaccaattatgatcaaaagcatgattacgaggttgatcagtgggttggcgatgtatctgcccagagatacaaacggctggctggaagttcccagaaggtcaaaaccggcattgcaaaatgcagatacagagtgaaaggctgccatccagatgcctttgatgccataatcacggaagaaaaccggaagcatggcagtcatgccgagcaattcaataaacaatgtaccctgtacgctgaatttggtcaggcggacaataccgccgattttcggtgcagaaattgcatcctgcattgtactgcgctgcatgagcgaaattttccgtccggataaaatggcaaaggaaacagcaacggtgatgacacccagcccgccggtctggatcagcagcaaaataactgcctgaccaaaagaagaccagtaactgccggtgtcctgtacaacaagccctgtgacacataccgctgaaacagaggtgaatagtgcctcatgaaaaggagtctgtgtaccggaaaccgaagagaccggaagcatcagcagcagtgcgccgacaaaaatgacagcggcaaagcccagtacaattaatttaaaggaggaaagtcttttcttcctgtgaaccacttttgacatatgtttaaatttctcctgtatttattctacgtattataacatcatctacataataacgcatttgtgaggatatacgaatttacagtaaaatttttgtaaactattatgcgtttgtatcaaaatgcgaaaacaatggtgggatttgtaagaattgcagttgtaaatatataataacggggatcagaatttgtatggaagatgtggaaaaaagaatggtatcagaaactcaaaaggatacatgttgattatttacagaatagagagaaagttcatcaccttgttgtgaaaaattatataaacttatatagggtgtaggaagttgtatgagcaatgcattttttaaaactttccacagaagaaaaaacgaaaaatctggaactggcgaaggcagttttacaggcagagaccaacaaacagctgaaggattaccggattccggcagagaagtacggcatgcgaatatataaatctgtacgaaaaaattaaaatatgggacatatgtgggaaaaagttatgaaaagatcctgcgagaaacaggggagtggacatatgtaaaaaatttgatgaaaaagtcccttgggagactgaaaacgggatgtatacaccaaaaataagacaaaaagtcccgtagtgatttctaaatgggacataattgcaaagaaagttgctatatatcctgaagagataaattgccgggatatctatgtaaagaaaaattttatatgtcccaacagaagggaggtgcgggatatatgaatttacttttttccgatatatcccattgttaaaaaaatataaaaatttactttacatgagaatgaagttgtgttttaataacgtcatattaatgcacagaaaggagaggtttttataacaatttatcatcagattctttcggagaagagaaggcttacgaaagaattacaacaaatcagtgaagaactattgcatcttcctgatggaaaaattatttgtgttcacaatggaaaccgggtgaaatggtttcacagtgacggtcacacacagacgtatattccaaagaaacacagagaatatgcacagcagttggcatacaaaagattcttattggaaaaacagacagagtgtaaaaaagaactgtatgcattagaactttatcaacgacatgcagttggtgaaaataaaaagtcggacaggtttctttcagaagatccggcgtatcaggaattgctctgtccattctatcagatggttacgcaggaagaacttatatggagtgatacttcctatcctaaaaatcccaattatcccgaacaattgaagtataaaagctgtaaaaatgaatatgtacgatccaagtcagaagcattgattgcaatgaatttgtatatggaaaaaattgcataccgttatgagtgcgaattaaaaatcgggaaggcagtgttttatccggattttacaattcttcatccgctgacaggaaaagaaatttactgggaacattttgggaagatggacttgcctgaatatgcaaagaatgccgcggataagttacatatgtatgcgagaaatgggatatatccgggagatcggctgattacaacatatgagactatggagcagccgctggatactgcaattgtgcaaaagttaattacttatcattttaaataattctgaaaggcaggaaaatgagagtattttgctctggaaatttatatacagggtatgttgataaacaaataagtatcatctgataaagattttgtggcggtattaaaaggtgggacatatgccaaaaaaggcaaggaaacctcccacagaaatccgaaagaaggacatatgcaaaaaaaggcgagggaacatcccacagaaatccgaaagcaggacatatgcaaaaaaaggcgaggaaacctcccacagaaatccgaaagcaggacatatgcaaaaaaaaggcgagggaacctcccacagaaatccaaaaacgggacataatcagaaagaaaatctgcatatgtcccaacaaaaggaaaatgtgggacatagtcaaaagaaaatctgcatatgtcccaacaaaaggaaaatgtgggacatagtcgaaagaaaaagctccatatgtcccacatcctatttaagtttacctgaaataaaatttgaataaagtttgtgaagtgatggtgtaagtttttcaattttttgcgatggtcaataaatcagccaccatttttacaaggtttaatcaaactcaagttcttcatctgcagattctgaaacagacgttttgtgaatataccggtcaattaaatttttcggaacagagatgtcttcttttatcagtaaatccagtcatacaggggacgtatgatataaaaagtcttgcgaccttccaataaagactgcggacctaatgggtcagcagttcttcataaatcccctttgtctgggtatcgtctacaccgcccatatagtaagttttcccatttgcggaaaattggatgaacgcatcattttctggatttaagaaaacattgacatcctcccctctggagatggtaaatgtgcctttttccaatgtatccatgctggtgccgtttgttctggtccagtccggcagatcacttgcggtaagaagtgtgggatctttgatttcactaagcggaatctgataatctgttttcagatgctgtgcgcatagtgtgtggttttggatcaccagatcaatgggagtaaattcctcctgaatcagccatatgcataacagagggcaggaaagcatcataatggcactgaaaatagtaagtccttttccgagggatgtggccatatttaccgttgtcccgatgccgacgcgctgttctaccatcgtatggggatcggacggattgtagtagaggatgccgccgatccagtttctgtcatcattttcatcgctggtcagattccgtttctgtgcatagcttcggtcaatttttttcagctttatcatgcagaaaatgcacagcaggagtaaaagcagtgtataaacaatcatgccggcgatggaacatattcccatgtgtctggcagacagggtaaggatctccagaaacaggatcagtgccgtgttcagccagcaggagatcagccagaagttcttccagcggtttttctttgcgcgtgcataattgatattcacgtcactgtccgtactgatgacggaaaccggctggcggtctatccatacagctgcaagccagaagaccagcccgcaggaggcaccgatcagacaggaaatcccaagcccgctggactttggaagcagcaacagggcacttgcgatactgatgatatttggcaggaaaaacgggagaaaccggacttttcttacggagccagcctgttttaattccacataatgttccggctgccggtcttcgtacagatggttttgcgttttccatgttttcaaccggtgattcgcacgcatgatcggcagggaaagcagaaaaatcgctgccagaagccagaacatccagatggtaagctgaatggacatatgggaggtcagcagacttacaaatggaacaatcgcaaggagaatggagtagtaacgcatttcctttttaaatttttgccggatgtctgcgacggtggcatcttttatccattcttttttcatgtttacggcaaacaggcgtccgttctcatacttgttttgtgtggaaaacaaaaacagcatgataaagacgatcggatacatggttgcaaaaaagataatattcataatcataacaatcaccccttatagatgcgtttgcataagtcgaaaaattctgtctgcgtcatgccgcttactttcgcttcggaaatgatctggcgcagcagttcctgggatttttccgacaattctttattcgtttcaaattcctgccgcacgcgggcaccgcttctgcggtcggtgtagatgtagccctcctgttttaagagggtgtaggctttgctgacggtcatggagttgataccgatctcctctgccagtgcccgcacggtgggaagttgttcgcccggagcaagccgcccgtccgaaatgccgagcacgatctgattgcggatctgctgatagatcggaatttcggaggcatcattgatggaaattaccatgttttctccttccgtaaatatcatacaatattttgtattagttacaataatacaaacaatacaaaatgtcaagtaaaacaagaaggaatctcaggcattgaaaaataaataaaaaagtgcataataggttatagaagaaagggaaattattctatgaaaaaatcaatgatctatcgcgtattgatctatattgcaggattattaatcctggcgatggaatcgtacaggcgattgcggattgtattcacagaagtgtcggatttacgaagaactgttttgatgtgctcaacgtgacaattacgattgtgatcagtctggtctgcaccgggcggctgcatggtatcgggatcggaacggtgcttgccgtgatccttgtagggcgtacgattgcggtctttaatcattttacaaaggaaaaactgacggcacttgccggaatcgaggagtaaacaggcggttacttttccagtggaattactgcaaacggggagcgttccctgttgtaggtatgcagtaaaccatctggaaaatttcaaatcatttgcggaatcagctttccgcatctgcatttttgtatgcagtaaaccatctggaaaatttcaaaccgcaatctacataatcaattctaaaaatattcgttttctatatagtataaaataatcaggaaattctcaggagaataattattcaatcaatttcatttcagttttcgtgagctcaagtcagggcatatttcaagcgtggtggtgacgaaaataagactatactattgaatcagaagcatctgatacccatcttgtactatcttttttggtcagtcagttgttatatatatagtttttgattgcgtgctgtttaaactgacacctgtggatgtcgaagcaaaaatcgtatgatgtttataagcaggcaattatggatgcattttcctagaatattgcgaagaataatataatactttacacagagattttaattttctgaaatgaacacgagtacaaatattgcaaatagtaaaaatgcataaaaaaataattggaaatatgacactacagacaaaaatgcaaaagaatattgacattaacaagaacaggtaatatatttaatttacaatataaatgtacacgtgtacaacacgacgcagcaagaatagttgaaggttatttgcttgacgaagcagaataattggacatatttcagaatggaggatatatgaataagtttaaaaagtttatggcattgggattggcggcaatgatggttacatcacttgtagcctgtggtggatcaacaggtaatgcaaaaaataagaaatcagattcatcaaaagggacaacagttactttctggaatagctttaccggagctgatggagatatgctggtaaagatggttgataaatttaataaggaaaatactgatggaatcaaagtaaagatggatatttcatcagattttgacagccagttatcaacagcatttgcagctggcgaagggccaacaatgattcttagctcaagtgcttacagatttacatatggggactatttgcaggatgttagtgatgtgtttgataagacagatttgaataaggatgattttattcagtcatatttggattattgttctgatggtgataaaacatatttcgtcccattccaggtagttggatactatatgtactggaacaaagatctgtttaaaaaggctggtcttgaccctgagacacctcctacatcatgggatgagtggcagcaggatgcagcaaagatttctgattcaaccaaaaatatttacggctcaggaatttcttatgattatgcctaccaaattgcacacattatgcagagatttgggggattggctgttactgatgataatggaacgtggaaggctaattttgaaaataatgcgggatatgagaatttccttaacatgtacaaagatatggtggacgatggcgataatcctcttgaagcagatacggattcaatgatgagtgctggacaggttggaattactgttggaggtccttgggtaacagcaggacttgacactgccggggtggattatggtatcgggcttattccacagggcgatgcaggagatatgaattctgttgaggttattggatttggtattacaacagcagcaagtgatgccgaaaaagaagctgcttataaattcatcgagtggtggaatacccaggataaagatggaagcagtcctgctttagagtggtctcttcagaatggattcccggcatatacatattcagttcaaaataacaaagaatataaagctaataagaaactgagcgccatgtcggcagctaatccggaagctcctacagattttatagttgattcaaacttccctggcattaattctgtattatcagatgttattccagagatgatcaactcagtggcatttggtaattcatcggttgaagatgcgttagcaaaagctcagaaatcgacccagaagatagttgataaatacaacaaatagcaggaaacataaatagcaaaagaaggggcggctttaataaaaggtcgccctttcaatagaaaggttgaagtaatagatggaaaaaataagaaagtattggaatagaccatcccgaagtgcatatgtttttatcgctccttcaataattttattgatattattcaatataattcccttaattatggcatttggtttaagcttttttgatgtccctattacgatgaatcatgctacattcgtaggatgggataattttgtggaagcatttcatgatccacgctttataaacagtttaaaggttactgcgatttttacaggcattgaggtacctgtgcaagtattaggggccttggtaatagcagcatttattagcaaaaataataagagaaataagtttttacgtgcagtgtactttctccctgttatttgttctgcaactgtaataggtattatgtggagaatgattttacattcaaatataggctttataacggctgctttacagtcaatgggattaggaaaaattaattttatgaatactccgggacttacaatatttgtaatctcgtttatatcaatatggagaagctttggtatttcgacaataatatatgttactgcaatccagcaggtatcaccttcattatttgaagcagctcaaatggatggggcgggaaaaattcttcagtttttacatataacagttccttccatacggcctacattctggtatatcatgatgaccagatttgcaggtgctcttcagatttttgatatcatatatgtaacgacaaacggtggaccaaattatactacagagtcaactgttagttatatatattcaagagcgttttcatcaaattcaagcatgggatatgcatcggcaatgtcggtagtacttttcattattattatgttcattactgtcttgatgtatagaagaatggtaaaggaggactaacggtatgaaaaagaaaaagacgataagtattgggaaagtattctttaatgtaccggttgctttgatattgatcataattgctttgctggttttagtgccggtcatttggatgacatttagtgctttcaagacagaaagagagatcatttcatggccacctacatttattcctaaaacatttacacttgaaaactttgtggacgtgcaggggcgaattaacattattcgttatattgcaaactctgtaatatatgcaggtgtaacaactgctttagctgttgtcgtaaatagtatggctggatatgcatatgcattttacgaatttaaaggtaaaacaggaacatttttgatgacattggcaacaatgatggttccttttcaggtaattatggttccgttattccttgttgtatacaagatgggaatgtatgacacttattggggacttataattccgagagtggcagttgctggttcaatatttatgatgagagctgcgtttacggggataccgaaagaaatggcagaggcagccagaattgatggcctgtcggaatttggaatattctggaaaattatgcttccgcaggtaaaaccagcggtaataacattggttattttaagtgttaatggctcttggaatgatctgttatggccgatgattgttacaagcagtacagaaatgagaacacttgcaaatggattagcattatttataggacaaaatactattgaatatggtgctgcttttgcaggagcacttgtttcattactgccgatgtttgtactttatatgtttggacagaagtactttgttgaaggtatgagcagtggtggattaaaaggataggagttgaggaagatggaaactacaaaagtagtatgtaataaagaatttcaaattgacagagtagattctagattgtttggctcttttcttgagcatatgggaagagtcatatattctggaatatatgaacctgacaacaagaatgctgatgaagacggctttaggcaggatgtgattgatcgcgtaaaagaaatgaatgtaacaacagtacgttatccaggtggtaattttgtttctgcataccattgggaggatggtgttggggctaaagaaaagagaccgcataaacttgatcttgcatggaggtcaattgaaacaaatgaattcggtacaaatgagtttatgaaatgggccaaaaaaacaaatgttaatcctatttttacggtaaatttaggaacacggggtgttgaagatgctgcacattatcttgaatactgtaatttttctagcggaacacagtatagtgacatgcgtaaatctcacggtgtagatgagccatacggaataaaaatgtggtgtttggggaatgagatggacggaagctggcagataggacacaaatcagcggaagagtatggaaagattgcggctgagaccggaaaggttatgaagttgatagatcctgatatagaactgattgtatgcggaagttctctgtcaagtatggatacatatcctgagtgggatatggaagtattggataaaacttatgatgttgcagattatctggcactgcatcagtattatgcaggacaggaaaagggaacaaaaacttttctggcacaatcggttgatatggaagagtatattcatactattagatctgttgcacaggttatcaagcaaaaaaaacgttctaaaaaagatatgaagtttagcgttgatgagtggggcgtatgggctgtgccaagcaatactgtaaataatgaaattgatgagaaaccatggcagatagcacccgcaatcagtgaacagatttacacccttgaagatgcgttattgtttgcagagatgcagatggtaataattagaaatgcagatgcaattaaaatcgcatgccagtcacttcttactaatataagtgcatgtattatgacagaaaagggtggggggcattggttacagactatatattatccattttattatttcgcaaattacgctaaggggatagttttaaatgtctcgagtactgggccagtatatgactgtaaagaatttaacaatgtgccttatgtagattctattgttgtatggaatgatgaggatggagagttagtcttttttgcagtaaatcgtgatgaagataataaacagaaagtgtcacttcaattgtcggattttgaagtagatagtgtaatcgaaagtatcggtatgacagcagcagataaaaaaatgacaaatcaatttcagcatgatgctgttaaaccggaaacagttgacaatgtgaaactgggcaatggggaggcgaaagtagtattaaaaccattatcatttaatatggttagattaagaataaatcagtaacaggaatatatagtgaatcctgagaaaatcgtgagttcattgatgataacaggcgattatggtatactctgactagaaatatacgggggtacggatatggcaattacagtaaatcagatagcagagcagtgtggtgtttccagaacgacagttcttagagctttaaatggtggaagtgtgtcaaaggacactaaggaacgaatattgcaggttgctaaagataataattatcgcccgaatcttctggctaggagcttaaatcatggaagaacaatgtcacttggggttgtaacaattaatatcgaaaacatgtactttgtacaatcattaaatactattaataaagaggctgataaaagaggatattttactaatatagtagtttgtgatgatagccttgaatgggagaaaaaacttattcagggtttggctgaacgtcaaatggaagggatattgattaacccaataaacaaaggaaaagaatttgaagattttctcttatcactgcatgttccggtagtatgtattggcaatcaggtatcagaaaagattacaactgtgcaggtaaatgaaatggttgcgaccatggatgcggtaaaacatattgtatcaaagggctatgagaagattctgtttatctgtcctccgcttgagatgaaagaagtgaaaaatacttatacgcatgagcagagagaattgggatttagaaatgctatggggatgtatccagatgtaaatatgcatgtaattggaaaaaatgaatttttacaagaagtgcaaacagtttgcaaaaataatctggataaaagaaccgcttttctttgttcaggagacagctatgcattgatgataatgcaatgggctgctaaggaaggctatgaaattccaaaagattttggattaatgggatttgatgatatcagtgttttacaatatatttctccaaaacttacaacggtttcgacaaatgttgagggagttgcatctactgcggtagtggaacttatccaacagatagaatcagaagtatattcgcctaagtctatatatttgaatcacaaaatattagatagagatacattataattaccgtattcatatttcctgtgcgaataaaggagatatgaatatgaataagaacaattatatagaaactgagtacaataaaccatttattagacagcgtgcagatccatatgtgtataggcattcggatggaagctattattttacagcttccgtgccggagtatgacagaatagtattgcgacggagtaatactttaaacgggttaagagagtcagatgaagtaactatatggaaaaagcatgataagggaatcatgagcgtgcatatttgggcaccagagattcattatctagacaataaatggtttatttattatgcaggaggagatattgatgatatatgggctataagaccatatgtgttagtgtgtgaaggacagaatccgttaaatgatccgtggaaagaacttggaatggtaaaggcaactgatgctttttctttcaatgatttttcattggatatgacggtgtttgaaaacaaaggtaagagatattgtgtatgggctgagaaagtaaatatcggtaagaaaatatctaacttgtatattgcagagatgaagtctcctacagaacttgctacagcgcaagtacttttatcctctcctgattatgaatgggaaagggttggtttttgggtaaatgaaggaccggcagtaatcaaacataatggaaagattttcttgacatattcagcaagtgaaacgggagaatgctattgtatgggaatgctgagcattggcgaaaatgaagagattttgaatcctcgtgcttggaagaaggaatgtaatcctgttttgaaaactgatgttgataagcaaatatatggaccaggacataattcgtttgtaaaagatgaaacaggtaatgatgtaatgatttatcatgccagacagtatgatgaaattataggtgatccgttgtatgatcacaatcgtcatgtttatcggatgaaaataaaatggaattcaagagctgaacccgtttttaactatggcaataacttttaacatgattttcagaaagaataaggaggagccactaaaacaagcaaatataaaaacagaccgcctaagtgaaaaatcaaagcggctaaatttccataccgaaaatacatcgaagatctggaaatgaatcttcttccggaaggaatgcgaaaatgcctaccggagctgtgtacgctggattttatcagagaaggaaaaaacatcattatgaccggcaatccgggaaccgggaaaacgcacacggctatcggacttggaataaaggcctgtgaacagggctatcgtgtcctgtatacaacaattccttatctggtaacagaactaaaagaaagtaatagcaagcaaaaactccgcacatatcagaaacgctttgaaaaatacgatctgatcatagctgatgagtttggttacatatcttttgatcgggaagctactgatttgttattcacagtcctttcattaagggcatcccagaaatcaaccattattacttcaaaccctacatttgagagatgggacgaaatcttcgaagatgccgccattacaagtgcaatcgttgataggcttacatacaaagcttatctgattgatatggaaggcgattcctacaggctccgtgaaactctgcggaacaacggaaccgacttcgaaacagtagtaaaatagtaactgcacctgtggcagtaatgctgcaggtgccaaacttggtctatagtgacctagttttcaatgagcggttgaccgaattttcggttgacaaatacagcaagtatttattacaaaataaaaagatctcaggattattcctaagactgagattttgattatataataacactgactaaaatgcccttctattttactgaatttcttctccattttcatttaaaaacttgtattgtatatcataatcagatggaatatttgacatgtccaaataatatacaaatggaatattattaatttctatatttttggttatatcagctccatttcgtggcgatatgacagcctgtatggtactaacattttcattattgcagactatgatatatccggtattcagtttacctaaccttaattgccatcctatatcattcaaggaaatggcatttttatatttatattttccatcctgatttttggaaaactgtgctgcataataatgatatgttttgtcgttttcccctgtcattccgacaactatggtagtatcattatctacaatacggccacactctatcatatcaacttcagcagatatattttctttttctttcacaacatctaacatttcatcaggtgtactcacttttttccgcaagcagcaaggcatatcgccaaagaaaggataagtaaaacggttacttttttcatcttattccgttatcattgtgattaaattactctttttcgtaacattcattatctatatagtataaaaaaatcagaaagttttcaagagaataaaattatcaaaattgatagaaaaatgttgttttggtcgtaaaatcttgaaacttgcgtaaaatagttgtaatttgtatatctttatgttattatcccactataacctaaaactataatcttagtttatactcaaaaaatattatcaatgttaacgatgaaaggggaaaatatggaggaactgactacagcggaatccatggtgatgaaaacaatctgggatcatccccatgaaatggcactacaggaaattatgaaactgacaaacgaaacatacgggaaagactggaaatcccagaccgtatcaacttatattgcaaagctggtgaaaaagggctttctaaggatgaaccagagcgggcgcaatgccacatatgagatcataataccggaactttcctatcagcaggagcagagtcgcaaatttgtaaaattctggaaccgtggatcggttgcacagtttttaactgctttttataaagatcataaacttaccaaagaggaaatagaggagttgagaaaaagcattgatgaactggatcaataatttgttttacatggggctgtttactgcacttacaggcagtattgcatttgcggtatatgcagttgttgcaggcgttttggatgggttaaaaaaataccgctatatatatgggctgttgcttgtggtgttaccgttctggctgtttccggggctgtttctcctgttgtatgttacgcattaccgcaaaatgggggaggcactgtttatcaaggggcacctgtttgaactgacacctgtgattgcgcacatagagtgtgtggcggcagtggtctggctgcttggtgcagcaacggttcttgtgcttcatctggttcgttattaccgggtggaacattacataaaaaagcaccggatgccggcggaaaaacggctgcagctcgttgcggcagggacaaaggagcgtttaaagatccggggaaatgtagaagtgtattgctgctatggtatttcttccccgatggtgctggggctatttcataaatggattgtattgccggtgagggatttttctccggagagtctgcagattgtgcttacgcatgagtttgtacatgtgcggcagcacatcctgacgttgaaatgtgtgggcagagtgctggaagatttattctggtataatccgctgatctatattttcaatcgcaggctggatttctggtcggaaatggcatgcgacatggaatgctgccgtgattccgaaaatgttttttctgtcggacagtattttcgtgcagcacttgaactgcttacggaagagacccgtcctctcgaatttccgttttccatgtttggggcgcagaatcatttacaggagcgtatccgccggatgaagcagtaccgaaaacaaaaagagatgaaaccactggctgttttggcaagttttattctggtttttcttggcagtatctgctttacctgtggagccggcgtcggtacacaaaaagctgtacaaaaaatctatgcaaagactgtacagcagaaaaaagtgaatgtacagatggaggttatggacaatcaggtctgctatgcgacgcaaatagagacaaatccggatgccggacacagttatatggtaaaggaagaaccgtatgatgtttataaacaggcagttatggatgcatttcctgaggatattacagaggatagcataaaactttccgcagagattccaaaacagacgttatgcaaatgggcggttaaaggaaaaccacagaaaatcagcatcacggtcgataccatccgcgcagacaaaacaatttgtgtgggtattctgacatccgcccataaacgggtctatattgaggcaaatggagaggtgggacagttatttgaaacatccggcaaagaatttatacggagtgtttttatagaaaatacggatgtagatacggttaagatttccgggattgctacaatgttaagtgattcagagcagaatgcaggaaatacacagcgatagaaaatcaaaaattgtaatttttataaaaaatcgttatactgtaataaacggtatagcgatttttttgtgaagattttaaaatttttggaaatatcagatgacagatcagtttccatacattgtctgcacttgactgtttgacattcataaaaagcgaggtaatttatgacagcgaaagaaagaaatgattatttttatgtgtgtgcattgattgagtatattgcaagggagaccttgaatcacagaggtgatatcgttaaagccatcggtgaagaaggtattaagaaactactacatgatgcggaaatggatcattgccttagttttgagcaggtcagtgataaaatttcagaatttaatacggatttatattatcagaatccggactaccttgaatggtcatacagagatggaaaattactggattaaaaactaaagtaaattaaaagggagcggattccattaacgaacttcttgggctgacgatcaaatcagcccaagaataatattaaaaaacagataaaggaaaagatggaggagtttaaagatgaacaggtggacgaaacggtgcatggcatttgtacttacattgacaattatatgtacttcaatgagcgcagtgaaaccaacagtggaaacgacatatgcggccactgtgcaaaatattacgaagtcagcaaaggttgtatgcaggaagacggttgcggtgaaagcaccgtcaggatataaaaattgtaaatattcaagtacgaatcccaaggtggcttccatagatgcaaagggaaaattaaaagcccttcgtctgggcgttacaaccatcacggtaaaaagcggtacgaaaaagaaaagctatacgatcacggttgttccggaaaagaaaagtgatgtaagacttaatcaggaactgattcttggcggacagatggttcagttaaagttagtatccgataagtatgatacaagtcaggtaaagctgtatgttgatagtgcctttaaggaaattgaccacaggggaaattgtaatttcaagaaatacaatggttatcaggcaagtggatcgctttattattcgtatgggcagtttaccagaaatattaccctgtacatctgtgataaagatgtgatttttgatggattaatagagaattcaaaggctggggtaaactatgatgcagattctctgcaatgggaatttttggggaaatcattccattataaacagttaaaaaataaaggcatcgaaattcagatggatggcagtgcattgccggatcagattgtttatactccgggagatcatacatttactgttattgccggaaaagagatatatagcaaaaaaattggtgtcagttattcggtcaaagatacgctgataaaaaaagacgcaagaggatatgcagaggatggaaaagctgtatttgatgcggcctttgcagcagttgatcaggtagtgaaggacggaatgggcgaggaagagaaagtaaaagccattcatgattatttaatctatcatgccaattatgtcaataatggagattatagtaccgcggaaaactgggcatatggagctggtggagtattgttacataaagaaggtgtctgccagagttatgcgtttgctttttatatgatggcaatatctgctgggcttgaatgcaggtttgtatccggtacagcagatggaggtggtcatgcatggaatcaggttaaggttaacggaaagtggtattatattgattgtacatgggatgatccggttggcggaggatatgaaaattataaatattatttatcggagagcctttggtcagatcatattgcagagacggcaaaagatctgtcggaggatggaaaatatgattgggagcattattatctgacaggagcagattatgccagataataagactctgtggcaagtttcattatctaagggttatttctgggacagtctagccgactgcctcagatagctctttttcttttgcagcttttgccgcctgttcacgctcttttctacgtctccaataagtacgattccaagcacgtttgcggcgtttgtgttcttcctcttttatctgttcgggtgtaagctcctgcatcggtccgtttccttctatgttataagtatcatgaaattttaattccataaatttatggaaattagtggagatatattgatatctttgttgtaaaaaatatcacgtttcctgtcggttgtcattttggtaaacttgaagttaacgggttcaaactgtaatctcaatttgattgccttcgattgcaacaatacagctttcgtagtaaccatctcctgttgtccggggaccgctgattacttcatatccatcagttttcaactctatggtcaaggcatcaaccttttctttacttcctacactaaatgcgatatgtgcataccccgtgcgagcaagctccttaggtgaatcaagcatttctggcttattcataatctccaatcgtgtgccatcatcaaatgacagaaaataggagcgaaagttagtttgcaggttatgatatccttcgtttgattttgcacctagatacttcataaaaaagctacgagttttttgcaggtcgtttacatataaagcaatgtgttcgattttcataattcacctccaaatttcaatctgttaatttgttttattatagcacatgtaagctcattcacaataaataagaaattgcaaaagaatcagttaccagttaatcaatgaattagatatagatgttcttccattttctccgaaatcattaacagtcttttcaaaatcataaatcaatagttccggtttatttctaacacattccttgatacattgaccagattttccaaaaaccattgtcggtgccgtttgaaaaggcgaggtagcatttactgaaatagtagtagtaacattttcaactgcacgagtttgcagatgtcctctaatcatactatatcgctccttgtcgtccgtatccgctacatcataaaacaaaaccacatttatgtcggtatttcttttatacaattctctgaaaaattcgggaaatcttatttcaaaacaaattctaattccaaacacaaccccatctatctcaactattccatcactattcccttttgcgaaattatcattatcccatccccataaagcccgcttgtcataagacttgatttgtttattaggctgaaatagtaatgctctattatatatttctttttctttaaatatggttccgacaataaaagaaatatcattttggtcagctaccgattgaagtctatcacacattgactgcacaaggttaaaattgacacatgatgaatttgatatatctctaggtggatatcctgttaatgaacattctggaaatatcagtaattgaacatctttatgttttgctaaatatattgctttttctatttctttataattctcatttacatctccagatatcgcaaattgatacgctccaattctcatttatcaatcatctccttttccgctgtaaaaaacatttacagctatataaacttgaatttcactaacccttaattggtatccatatttcaatgattgaattttctctattccaatgaaaacgataatcgtatctttcaaagtgcaaaaactcctcttgcagaggcgtgtagtccgtattaggtaatatttcctgataaatctttctgtaagtttcatataggttatccatagaaccaatatgctctacagcaagatatttatacgactgtatgtctttatagataaagccgtctggaattacgtttctttttggaatagaacaaaaataaaacagttttccgtttctctttatcataaaggcatattttatccaattctcaaattgcgaaagataggatttcttcaaatcagcgttaaactttctccaaaattgtgtgctgatttgaatatttcgtttatgataatttgtaagttctacttcttgtcctataactgaaaatgcttctaattcacgaattgtatatttcatttcttttccctatgtgccgtaataatcgtataactataagcatttacagttatgatacagttatctatattcacataccagttcttcccacttcttgtgattacagcctttacagaatcgattttagctttacaccagccgactacatcatctgtatctaaaaacagatttcttttaatgcgttctacgcctaattctgttgtgtgcaatttatccaaattctttagtaattcatcatctgcattcattttataattatccatttctcttcataaaattacgattgttctaattcttttcacgcccaccttcttgcccttcggacaagaagtatccctcgctcaaagagctcggtcaatcccgatttgtcagattctaaaaaactattttccgtaattgtatcataatcgcataatccagaaaagtaattattttttcttttccaatccttttaatatcttatcaaaatcagattctatcggctgtgtcttgttaaaaatatcatattcctgatatgctttctccactgcctgcttatgggaaacacgtccattatctttcaagatatcgtatctgcggaacgcaaggaactcgttcacgctttttgaaaattcctccattgtaaagacgttttcacgttcaatcaaatcctctatgtaatcaaaatatcctgtgacagcacgttctaactgacgaatctgtttctcgtccaaatagtttttggcaatcggtgtatcagatttgagaatacgaccatcgggagcatttttccatgtggtcaagcccatattttccttggtgtggtcagcctgattatagacgatttcagccgctgttttaccggtaatggcataatgaaatttgttctgtatggttgcataaaaatgatatgcagtatcagaatctctattgtaatcaatgctgcactcggcaaatatatccgttatctgttgccatattctgcgttcgctggcacggatggagcgaactctttccagcaattcacggaaatagtcttttccaaaagctgttttaccctgcttcaggcgttcgtcatccatagcaaagccctttatcatatattccttcaaaataccggttgcccatatacggaatctggttgcctgaatggagtttactctgtaaccaacggaaataatggcatctagattgtaataattggtaggaatagtctgcgttttatcctgcattgctccgtgctgagtggttgttgcaatttttgcaacaaccacttcctcatccagttcaccggattcaaaaatctttgctaaatggcggctgatgcccgatttgtcaataccaaacaattcagccatagctttttgtgtcagccatatcgtttcatcttttatcaaggcactgaccgttacattgtcatcttcggttctgtacagtaccatttccatttgctttgtaatatctgtattcataatcagccttctttcttatagcagatgaattagttagtgttgtctttatccttagcccggctcttatacacattataccggtttttacatttaccactgcaaaatacgctgttgggtctgctggcaacaaaggcttttccgcagtgtttacataccttcagcgaggacttttcatctgtaagcataaaagaaaacatcatctgcacatcgtccgtattccatgaagatttatcttatccgttgtcgcagtccatcaaagatacttcaattataacaaacatatgtttgcatttcaaggaggaggtgaaattattatggagcagacagcaagtaaggagcgggcgatgtcctcttttaccaaaagaaaaggacagaccacctataaggtaaatgtgtttttcgcagagaataccacagcaaccttgccttatgtattgtcagcgtaactttggcattgattgccgtaaggtatattccagtggatatcaatgtagtgagctggaggattggcttttcggtctgactgaatattttgtatcatggctgctgtaagataaatcactaagctgaaaaaagtactcccacgggcagataaaatctactcgtgggagtgtggtaaaattagttaatgtgaaagttccttttaatttgttaaaccggcatttacaagtgcctataatttacaaatcataatatattcttcatcattttcatcaacgatttcaaatcctacattcctatacatgcgaacagcataattcatcttttgaacagataatgatgcttatttatatcctgctagttttaatttcattagcatctgtttcattaattctgttccgataccatagtttctatactctttaagaagtgaaattgcaaaagacggtgtttcattatctatatgcccgtaatcattcataatccgaacccatacagcaccaacaattttatcactaacttgagcaaccaaacataagtctcccttattcttaccaaagtcttttacatatacctgcaaatctggctggttaataatatctttggatggtgcagaaacacattcgggaataaaaatcgcctcgtacaaaaaagtatctaataccttaccaaataactttgagtttatatctcccgatggttataatctttctcaactcaaccttcttgtccttcgaacaagaagtatcccagctttaagctcgatcaatctaatttttctctttctattgtaccatgcacaattcttatattccacttatattttcccgaagattcttagaaaggtggactgccatacatagcaatccacccataaaattaccacactttatgtgtcctagaattatcctttagaaagggaaacacaagagggctttgcatcatgcaaagtccttaattattactcccgcttggaaacaaaattttctacaatatcctgaatcaatggaaggtcttttttgttgcacaaggcaagagaatcataaatatttttcgggagattgtccgtgtgcaggcttcccagtaaaagaaaatcgggagtggtatccagctgctcacagatttttacaaatgttgtcaggcttggaatctgttttccggtttcaatcgaagaaatatgattgttggaaacatttactttttctgccagttctgcctgactcatttttaattcttttctgcgtcttttcatgcgtgtgcccatggcatttagatttatatgcatagagttccctgctaatttgtattttataaagtatctttctaatgcattagcatatcaaaaaacagggaaattaaaacaaaaagtgaaagaaaagttctgtaatacatggaatatttataacattaagagaagaaaagttctgtaatatatgaaatactggaacaaaactttacaaataaatgtattccatttatgatggaaaaagaaaggtggacaataccatgagtgatcagatcgaaagagaacagcagatagaagaggaatccctgacgaaaaacagtcttcagatacagaaagcggcatggatccgggaggaactggaaaaacgccgggcgcaggaagatcagcttttgcagcagatcctgcgggagcagcagatgctgcaggaactcgatgaagacatggatcagaatatggcgcatgcaaaagaggggcggagataccgggaagatatgaaagcgcgtgtggacgaccgcgtgtatgaaatgcatgacctgagcgcagacaaacgggagggcatgcgggaatacggctatgcgtaccgcaggggctatgcactggcaatggttttcttttcgctggcgttgtgtgtgtttgccgggtatctgcatggcatcgcttcccagacatgccttgtacttatgttttttaccggagtacaggcagccattctggtacataaaaaacagtgcccgaagttctggcagtttgtctgtgatgtgttttctgcgttgatttttccggggatgctgatcctgtttattggttgtgaactgcactattcttattacgaacgtgcactgccctattgtctggccgtcggacttttcctgcttgcactgacaacggcttcttactttttatacgatccgtaccgcagtgcacgccgcagggtgggagatgccaaaagcatgattcgcagtatcgagcggtctgcaaagaaacaggtgaaaaagaatcagaagcagcaggcaaaagaggaactgcgacaggatcgtctgcagaaaaaagagtccgaaaaactgttgaaaatccaacagaaacaggaagtgcgcttagaaaaacaggggaagagactgcagaaatgggaaacgtggaaacaacagtttctggagcggtttcaaaagagtgaggatattgtggatgaagaggtatccgacgagacgttgccggatgcggctgcaggggatgagacactgccggaagaggctgtggagaacaaagcactgccggcagaatccggggaagaagatccggatgatccgcacatttgatacacgggcaatcaggcatatttacttcacaacaactttcattttcgctttcctgccacttccggttgttaccgtaatcgtggccttacctgcttttttggcggtcagcttaccggtctttttattgaccgcaacaacctttgggttggaggacgtaaaagatttgcgatccgtgcagccattcggttttattttgaccgttgcctgcgcggtcgtattttttttcatggtaagtgtgggtttcgtgaacttaatacttgttgcttccatataggaatagaccagatcacaatatcctttgtccgtgttggcaccttccagtgaacctttctttgtatactgccataagtctgcagataccggtagctttggtttggtatcactgtaagatgcaacccagactttacagtttttcaactttttccagtcaaagttttcgttcaggaaggaagcggaagaataaatcatcggcacataaccggcatcggcgatcgtgtcacaaaaggcctttgcaatcgcagtcgtattttccctgccacctgcaaaggttcccttgcgctccatgtcataggcaaccggataatccagatcccttccatcaagaatctccagacaatactctgcttcttccacggcttctttcggagttcgcacgcagcacacatgatacacaccgactttcagcccggcagaaacagcaccatcataatttgccgcaaactgggtatcaacatccggtgcccggccctctccggtacggatcattacaaaatccatgtctgcttctgcaacctgttcccagtttacggttccattatagcttgataaatcaaatccctgtccacgaaagtctgctgcctgcacaacggtaaccgggattattgtaaccatccatagcgtcgtcattaccatcgccagaacacgaaatccatttgtttttatcattttatgtctcctgtttatcttaacgtgttttatgtctcctgtttatcttaacgtgtcagcatgccgtgatgttcttccataaatccgctgaagtgaagatttttgtaaccgagttttttaaatttcttcatggcaacgtttggtttgtggtaataacttccgataatatacagtccggttgttttgtccggaagccggcggcagacacgttcttccgtgattttttcgattggaaaattgatggcaccggctacatgtccgtgcgcataatcttctttgggacggcagtcaatgaggactgcgttatcggatgtggttactttatttttggcctcgttgacggtcagttttttcataaaaatgcttaacattgtaaaacccccttaataaaagatgcaactattcagattattataccctatttggtaaagattgcaagaaaaataacggtgggcacagcctgtgtttcccgttttaaaggataattttaggagatataataatttatcaacacaaccgcctatctggaataaaacggaaaggacgaaaacagattatatattcctcccttgctggcaatcaggaagatttattgtcaatccctgtctctccgacgatttcaagcaagtttggtattaatacggaaaagccgcaacggtaataataattgtaatttgcccatcaatccgctatactatagctaagtatagcggattgatacgttttgtggaggttcatatggcatgcactttaaaactgccggtaggaattgatagttttgaaaaaatcagaaggaataaattttattatattgacaagacaaagctcatagagcaattggttgaaaccggtggagaggtcactctttttacgaggccacgtcgtttcggtaaaactctgaacatgagtatgcttaaagccttttttgaaaccggtgcggatgagtcattgtttgatggcttatatattgcgcaaaataaggcactttgcgaagaacatatgggaaaatatcctgttatatttctgtcattaaagagcgtggagggattgaaatatgaggatgctagatatcgtattactgagctcattggaatagaggcagaaagattcggctttttagaagatagtgaatatttgtcagaaaatgaaaaaaagcgctacaaggcgattattgcattgaaggatggaacgaatgcaatggatgaaaaagtgcttgtatcgagtctgcagattttatctcaattattatataagcattttggacaaaagactgtaatattaattgatgaatatgatgtacctctggataaggcattccagaatggttactataaagagatggtttcactcatcagagggctctttggacaggcactcaagactaatgagtttctacagtttgccgtacttacaggctgtctacgtgtatccaaggagagtatttttacaggtctcaacaattttgaaatcaattccattgtagatatcgcgcatgatgaacagtttggttttactgatgatgaggtcaggaagctgcttttagattatgacaggtctgagcgataccctgatgtaaaggagtggtatgatggctatcatttcggtaataccgacatttattgtccgtgggatgtaatcaattttgccaagaagctggtttgggacccatcagccaggccgagtgcattctggattaacagcagtggcaatgacatggtgaagcgctttgtggacaaggcggaccagactacgagagatgagatagaaaagctcgtggctggtggttttgttgagaaacagctccgccttgacttgacctatgatgagattgacaatactatagacaatctgtggagtgtactttttacaacaggctacctgactaaggctggtgaggtcaggctgcctgacagcgagagctatgcctacaagctggtgattccaaataaagaggtgcgtgaagtgtttgttctccagattcaggagtggttcaaggttgttgtcgcaaaagatgatgataccatgaagcttttatccagagccatccttgataaagatgagaagcagattgcaagacagcttaacatcgtgatgagccgcatgataagtatacttgataccaaggcttctgatgataggaaggagaacttctatcacggtctgctcctcggtctgcttcgcggaagcaatccgggctggcttattaagtcaaatcgtgagtcgggagacggtttcagtgatattttaatcaagccggaggacccggatgcaggtatcgttattgaagtgaaatatgcaaaagagatgataagccttgatgcagcgtgtgaggctgctatggcgcagattaaggagaagaggtatgatgaggctctgcgcgatgagggcaggtgcgatattttagcatatggtattgctttttgcaggaagaggtgcagggttgtaggagaaaaaataaatgattaaaaacataatatttgatataggaaacgtgcttgtcaggttccagccggacgaggcaatgcgtgagattggcattgaagaaaataaaatagcagctttagcccatgcaacatatgaaaaccctgtctgggttgagctggaccgtggtgtaattcctgagaacgagataattgatgagatggttaaggtggctccacagtatgaggcggatatcaggagatttttcaaagagggaaaggcttttgttgtaaaggcattcgactatgcagcagactggattaaggagttaaagagcagaggctataaagtgtatttgttatcgaattatccaaaggaatatttcgaacttcatacacacagtgaacttagttttgtgtcacttgttgacggcaaagtcatttcagctatggttgggatgataaagcctgatgccggtatctatcagtgtctgtttgataaatataatctgaatccggaagaatgtgtgttcatagatgacagactggagaatatcgagggtggcagaaagcttggcatggagggaatagtgtttacagactatgagaccggaaagaaaaagctggagaggatgctgtctgagaaataaaacagtattgtaaaggagtaaggttaaaatgaagatgtttagccacagcttaccagtccgtgcacgtcaactattgaaagcaccgtataccgaacggtacgtacggtgctgtgagaggacgatggttaatcacagcctcctactcgattagttatccaacaaccatttccaaataggaattacctcaatattgatcccatcgcaatcaatcaccgcctcttcgctattagtaatgagaatacatttggcgttggggataaaattatttagcttcacaaaggctctggtttcacgttctcttgtatctatgttatccagaacctgcatactgacctgaatagcaagattgtctaatggtatataaaagtcaatttctacattattctcaaagaaatagacattttcggtaccataacgtcgtatcagttcgattgcaacaagattttccagctgagcagatttgcagtctagcagcataagtcctagaagtccggtatccataaagtaatacttaggagaagtctctttttctacaagtttggcggcatagttttgcagagtaaagagcaggtaggagtctgtcatatagctgacatagtttattacggtttgtttaccgatagacattccactactttttaatatattagtcagtcggttatacgataaaggttttgtgacagattctgcaattttctttaggattagccttattgcaaaatcattggtgattttatttctggttataatatcaccgagatacacagtttgatagatgctgtttaaaaaagctcgtttatttcttatttcaactaattctggaaatgctccataggttacatatttgttatattgattttggacatctgccctgtctttggtgctaataacatccaggtaattctttgtcatattatttgcaataagatattcagagaaagaatatggataaatattcataataacaaaacgcccgcctaaagtggaagctatttcgctgcttagcattttactattactgccggtaatattgattcgatacttcatatctgcaattctgcgaacgaatttctcccatccgttaatattttgaatctcgtctaaaaataaatatggtttgatatcagtttcagatatttctaatccaatttctaaaatgagatttaaatcttcagcagtcatttccaaaagacgctcatcttcaaaatttacataaataatttgggataggggaattccatcggcttctaattgttttatttgttgatacatcatatatgactttccggttcttctgataccaacaaagcaatagttgacattggtttctagaaaatattgtcttgttattaatggattgttgagataaatatctttttgatcaatcatgatttgttttaaagtatctcgattcataatatatgtcacctctttctatatgagataattatatatcaatatcgtcttgtacacaagacaatattataaataagttgtcttattcaatgcgtatagagatatagatagtatatgcgtatttatgggtattataacagggagccgattggcttgtcagataatccggaagaagggtgatgcttgttaccattatcaccaatattattgatggagcattaacaagcatttggctgttaaatgataggattatgaatagtggattttttgatggtattgagcagttatttggaacggatgcagaagttatttcacatgtttttatacattttaataaggtatttctctcaatcatcattttggcattaacaattaatggcattgaaacagtcgtgaaagcagtaaaatacagtcgacaataaaataattttagatgaatcaatctccatttacaaataatagtgcgaatttctaaattgtagaaataataaaatgtaaatggagatatgagtagaagcatttcaatcagttcaccatgtcgttttcattttgtgttatactgtttagagaattttctttcccttgtttttcccttatcagagttcgtaaatccatatgggaagatataacataagggaaagtctaagaaaaaactcacctgcgataaatccagtgttttcaagggattgcggagaatttaataacaaaatataacagttattaaatttcttaaaacaggtgaaatctcaattcttgtttgtagggatgacagaatcacaatttatgagatgttagaagagaggtgcacatgctatgccaggtatactcgtggttgaagatgatgaaaatttaaatcgtggaattacattctcactgaaaaaatccggatacgaggttttttcagcagaatcagtgaaaaaagcgaaaagaattgcaagtgatcataatgtggatgttaccatttgtgatgtgaatcttccggatggaaatggactggaatttgtaaggtggatgagatgcaattataatacatacattatctgccttacagcactagatcaggagatggatcaggttatggggtatgaagcaggggcagatgattatattacaaagccctttagtctttcggtacttcttttgaaaatagaagcacatttccgccgcagacaggagaaaacggaagccggaaagatgatttcgggagatatcgtatttatcgcaggagaaatgaaagtcctgataaagagtcgtgaaatcagtctgacaaaaacggagttgaaaatgctgactttttttctgcagaatccgaaacagattctttcaaaaacacaaatattggaaaatgtgtttgatctggaaggggattttgtggatgaaaatacaatcgctgtcaatatcagaagactccgtgagaaaatcgaagacaatccggctgcaccggtctatataaagaatatcagaggtcttgggtatatatggaatcaggaggtaaggcagtgacaaagagatatcgcaagaagatcacagtagtgctctccttggtattacctgtcatagtattgtttgcaatattaaattgctttaccacatatgtgttttatgaagactataaatataaaatgaatcttatgacagagattgctgcaaaggaagaattttgcgggctggatgctgtttcggaattgcttaaggataaggatattgaaaccaacgaacatggaaggcgattattggagcaatatggatattgggggaataaagggaatgcatgttattcgcaattccggcatcaggttatggtgaccggtgctgtaagcactgtgatatgcgtgcttcttttgacttttttactttattggaagaaaaaagaagatgcgtgtcatcagaaaattttagaccagttggaagaaattctgatcagattccgtgaaaataaatttgatgatttactgaaaacggaaaatcatgcagaactggaaaaattgaatgaccagcttgaagcaatcggacatcatattcagttgctaaaggaagaagcacgggaagaaaaagagagcacgaaagaaatggtttctgatatctctcaccagttaaagacaccggttgcagctttggatacatgttttagtgtgctgatgcagaatgacttaagtgccacagaacaggaggagtttcgtatccgttgtcggagtgctctggatggactggagacattattgcagtcgcttcttgaaatatccaagatggaaactggactgattcagattaataagaaaaaacttccgcttatggatactgtcatatctgctgtgaactgtacttatccaaaagcggatgagaaagaaatggaattcgtttttgactatgcaaaagagctggaaacatgcatggttatgcaggataaaagatggcttggtgaagctgtgatcaacgttctggataatgcaatcaagtacagcccggatggttcaaaaatatttattcggttacaaaaaagaaacgatcttgtaagaatggaaattgaggatcagggaattggtattccgcagaatgagtatcacaaaatttttcaacgattttacagaggaagttccaggaaggtcatggaaaagagtggtacaggaatcggactttttctatcgagagaaattatcgaaaaacacggaggtacaatcatggtaaccttcggcaaaaagaaaaaaggaagcacgtttgtgattcaattaccatatgttggttaaattttaagtgggcagaaatcttacaattctgtaagacttctgctcgttttttgaaagtgaaatgaaagattatcctgatacaatttggatgtaggttgaaaaggtacactttacagaatgaaaaaggaggcaacacatgagtgtgatattagaaaccaagcagctttgtaagttttatggcgcaggtgagaatcaggtcaaagcggttaatcaggtggatattcagattgagcagggagaatttgtcgcaattgtcggaaagtcaggttctggtaaaagtacattacttcatatgcttggagggcttgataccccgacaaaaggcagtgttactttagccgggaaagatttatacaggatgaaggaagatgcccttgctgttttccgcagaagaaaaatcggatttgtttttcaggcatttaatctggtttcatctgttaatgtctgggaaaatattgtactgccactggggctggatggaagaaaagtggatgaagcgtatgtaaatgatatcattgcaactctggggattgaaaaccggatttataatctgccaaatcagttatccggaggacagcagcagagagtagcaattgcaagagcactggtgaatcgtccggaaattatatttgcagatgagccgacaggaaatcttgattccaagaccagtgatgaggtaatcgccctgcttaagatgacagcaaaaaaatatggacagacaattgtaatgattacccatgatgacgaaattgcacaggtcgctgatcgtattctggtgattgaggatggacaggtggtggattttagatgaagacaataagcaggattgcatatagcaatgacaaaaagaacaagacaagaagtatactgattatgatgtccatatgtttgaccacgatgctgcttgtgattatcagtactgtgggaaatggaatgatccgtttacagaaaagtcaggcggcaggctcatatggaagcaattatggtttgtttgtcgcagcagatgcctcgcagttaaaggaagtaagccgccgtgcagaaatagatgcaataggaattatgtgtacagaaggcatcataaaaggcaatgaaaacggcgggtttgtctgcatggatgagactgcaagaaaaatgcttccctataataaggaatatgagttaaaggaaggaaagtatccggaaaaaatgcaggaaattgccgccggaagagctttttttcgtgcaatgggatatgatgatgtaaaggtcggagatacggttacactggattaccgtgcagggatgcggtcagaatataagccggaagagtttgttgtcagcggaatcctatatgaccgggatgagtataccatcgaggcatcttatgttgctttcgggtcacaggagttttatgatgagcacgtcgcagagaatgacagacagtataatatttattttactttaaatgattctgcaaatgtatctatgaataatattgaaccggttataaagcagattgcagcagcttgtgggatcgaagaaaaaaacgttatagtcaatgatctctatctgcaatgggtcttgcagccgagttatgaaacgattgcggtatgtggaattctgattcttgcaattgtacttttctctgttgtggttatttataatatttttcaggtcggtattgtcaacaagatacaggagtatggaaaaatcaaggctctgggagcgacaaaaaagcagatgaaacaactgatcttcagagagggcatttttttgacaattttttcaataccggttggattgcttcttggttttctgattgcaaaatgcggttttaactggctggtagaacagggaaaccttgtatcaaccggaatgggctctatgggagtccaaaatcagcaggtgccactgttttccctgcctgttatacttctctgtattttcgtatcatttcttaccgttgctttggcactgcgcaaaccaatgaaaattgtttcacggatttcacctatcgaagcaacacggtatttagaaaatgcagaaacacacaaaaaaggaaaacgaaatggtagaaaaaatgtcaccgtgttttctatggcaatggcaaatgtaacgggtaatcccaaaagaactattggtactatcctcacaatgggtttttcttgcgtattgtttgtgattatctctaattatgtaggaaatattgatacggagcatgaagcacgtctttccgttaatcatggacaatttgaactgcagcttgactattctgctgagtatgatgaaagatatccggagaataatctggatacgattctgacggatgatccattgaatgattcgctgattgaagaaatcaaaagcattccgggcgtgacagatgtcatgacgagagagattgtctctgtaaatctgaacggaacaagatttccggctgctattgtgagtaaaaatgattttgattttatgtgccaggacggggatattggctctatggactatgatcaggcggtaaagaatggtgaaattttctttggttggttgatgtggatggaagaagatggatatgctccgggtgaatccattgcatttgactttgagaatggaagtggaacctatacctatcagggaaagattgcgggatcctttgtaagtgcgggcacttatcttgtcattccggaaggtgtataccgttccatgaatccgagaggaacagcctatggctatctgtgggtggactgtgataaaaaagatgaggcatctgtagaacaaagtctgaatactttgatttctaaatcttcacatataaaaatggatacctatcatgcgcagttacaaaatgcagaagtcgcagcccgcatgatgaagctcggctgttatctgtttatagcggttgtaggactcatcggttttatgaatatggcaaacaccatgatcatgaatattacgacaaaaaagcaggaatatggtgtattacaggctgtgggtatgacaaataaacaattaaatttatgcctgcagttacagggactgatttttacggttggtaccatatgcgtagctttgatcattggtctgccgctcggctatgcacttttttcctatgcaaaacataatggaatatttggaatgaatatctatcatgttccaatcgtaccaatttttattatgatttttttggtcggtctgttgcagattgtactttcctgcgttttaagcagtaatctgaaaaaggaaacgctggttgaaagaataaggtatcagggatagcacttattcaacaggcggaaaaaaatatgatataatgcgtgtgtatgcaactccgacatcaagtaatatgttttcaatctgaaattaatgttggtacaattttgggaattgtaattattattattggatttttagtaagagttatattttacagatgcccagaatgcggtgtcatgattccatggagaccattaaatgtaaagcattgtccaaattgcgggaaaaaattatagtattagctcttttgatttttccatagagaagctcgaaaaccaaattatattcgaatagataaaggaactgtcactctctgagatactgggagtgacagcttaatcatcacagataaaaagaatcttctgcatctacccacatctgcaccgtcccatcaagatacagccttgcatattcaagtggctcatcaatagcaagagcatttaatgctcagtctgaacagggtgtggttttcaaatttttttcagcttcccaacagtcaatgcggagcatatagcctgcactggtataaacatcaatgctattgcgttggggattgtattctgcaaatattgttttcatctctttaagaaaattgatcgccatatataaaattgtggctaaatttaatccggaaacactttgttcaaatcgatttaaacaaaaacaatttgaatagaatgagtagaaaatctgaaagatgaagatattttggtgaatattaaccgaaatatcttttagaagattgcatagtatcatgctgctgggtataatagaagatatttagggatacaataaccgaaatatcttttgggagaaaatgtcatggtaaaagaaattaaaagagattactatttagaacaacttataaagcgtgaaggaaatggtctgattaaaattgtaacaggaataagaagatgtggaaaatcatatttattgcgaaccctgtttaaaaatcatctgcttgaaaatggagtggatgaaaaacacatcattgaaatggcgtttgatttatttgataatatagaataccgagatccgaaaatcttttacccttgggcaaaggaacaacttcaagataatgaaaaatactactttcttttagatgaagtgcagttgctggatgagttcgtgagtgtgcttaatggtttagcggataagaagaattgtgatgtgtttgtaacgggaagtaatgcaaagtttttatccagagatatagctactgaatttggcggtagaggggatgaggttcatatgtaccctttgagcttttcggaatttatgagttgctatgatggaaataaatatgatggatggaacgaatatattacttatggaggtattccgttggtggtattagctgaaacggatgagcaaaaaatgaatctattggataatctgtttcaggaaacatatatcagtgatattgtgaaacgaaacaaaatcagaaacgttggagaaatggaatcattgcttgatgttttggcatccgcaattggtgccttgacgaatcctaacaaacttcagaagatatttaaaagtgtaaacaattcgaagattacagcaacaacgattacgaaatatattgaatatttggaggattcttttttaattgaagaggcgaacaggtatgatattaagggaaaatcctatatcggtacgccattgaagtactattttatggatatgggactcagaaattcaagaattcattacaggcaactggaagtgacacattctatggagaatgtcatttacaatgaattaagaatgagaggctttcatgtggatgttggcaatctgactgttgttgaaaaggggaaggatacaaaaccggtaaaaaagcaattggaagtcgattttatctgtaataagggttctaaaaaatattatatccagtcagcatatatgctggagacagaagcaaaaatggcacaggaaattcgcccttttttgaaaataaatgattcatttaagaagattgtaattacatctgatatacccaaacctttttataatgatcagggaattttaatcatgaatgtatatgattttttattgaatgcagattcgttggaactataggaagtaaagggcattacttgaaagagtgaaagatgcatatatattaagaccgccttatgctatgaaagcttaggaaaaataccggaatttgtatttctaactttccctattttacaggctttccagcctgtgcattagcgaaacgatatgtattttcccttatttttgcccttatgagataatcgtaagggaaataagggaaagttttatttagtcattgcctgccactttatcaagtaaccttgcagattcccgcttggcttttcttgtagagtgtgcatagacattcatggtggtactgacatctgagtgccctaacagttcctgcacatcctttggttctgctccatttgccagaaggttgcttgtgtaggtgtgtcgcaactggtgaaaatgaaatccttcaaatccatccagtttctgagcaatcttcctgcaaacaattcctaacgtgcttggcagttccaaacttccatccggtcttaagcagacaaaggatatttccttataatcttctggaacattctctgttccgtccagatgatagaactcatagtaagctctgtttttgtcttttacttctctgtagtagtttttgtggtaaagttctccgtactgcattcggtttttaagttgttcctttcgggcagtgcgaagaatctctgccagtgtatctccaaaatcaacaatccttaccttttttcgtttggttggtccgatgatattcttgtgccttgaaccatcatatcggatactgcgtctgattgtaaggcactgttcttcaagattcacatcatgccatgccagaccacaggcttcaccgatacgaagtcctgcataataggctatctggattggaagtattgccggtggattgtaattctgtagaaattcaatcagtctttcataatcctctcgtggaattggctgtatatcgccatccatgtcatcatcagaaaacaggtcaacctcatccgtctggtatggaagtatattggagaatatgtatgacacataaaaaactgatatgtaatttacgttagcattttgagttgcctaaattcgaaagttaggaaaatcttaataatttctcaggcaatccattgtgaatttagatgttgtatttgctatacttaattggatatatgagcaaaggagttgaaaatatgtctgaaaagatattgattatagatgacgagcaagatatagcggatctgttggaggtctacttgaaaaacgaaaattacgtcgtttataaattttactgcgcaacggatgccatgtcgtgtattgaaagcggcgacattgatcttgccattctggatattatgctcccggatatgaacggcttttcactttgccagcttatccgaaagaaatacacttatccaatcataatgctaacggctaaaattgaggaaacggataaaataacggggctgacattgggagcggacgattatgtgacaaaaccctttcgcccacttgaagtagttgccagagtgaaagcgcagttaagacgttacaagaaatattcacccggtatcatcacagagaaaattccatcggaactttcctataacaaattgtgcttgaatgtgcagacccatgaatgtctgttagacggggaacctgtttctctaaccccgacagaattttctattctccacgtccttttgtcaagtgctggaaatgttgtaagcattgaggaactgtttcatgcggtttggaaagatgaatactactctaaaaacagcagcacaattactgtgcatatccggcatctgcgcgagaaactgaacgatacttccgatactccgcagtatattaaaacgatttggggtgtcggctacaaaatttaagcgaaaggagaacgctatgaagagaaaatcaaattgtttggcaactattttatgcagtatatcttagcagtcggacgttctgatattactgatgtactcacaaatacggcaggtggtcttttggggcttgccgtatattcgatggcagcccggttaatcggaaatagaataaaagcaaacagactgttttccattctggcaggcatagtaagtgttgtcgtgattggtctgcttggctttcttctgtttgctaatcggtaggaggtgtattctcatgtcgaaaaaagaaatgacaacagaaaagcgccttaaagtgcgcttatacctatcattgctggtttataccgttgttggatatggtttgacccttatcttggactacatcttttcaaaatttgacaacggtatttttgcatggctctactggcggcttgatctgctttttattttgtatctgatgctcggctttatatgtatcttcaattactattggaaaaagccgtggggctatctggatgaagtaattgacgcaacccaaacggtctatgagcagaacaatcataccgtatcattgtctgacccactgaaagaattggaggcacaactcaatcaaatcaaaatgtctgttctgttgagcaaacgggctgcaaagcaggcagaagaaaagaaaaatgaaattgttatgtatctggcacatgatatacgcacccctctcacaacggtaatcggctatttgagcctgctccatgaagcccctgatatgcctgagcagcaaaaggaaaagtatgtaaaggtcgcgttggacaaagcagagcgtcttgaaagacttatcaatgagctttttgaaattactaaatacaatgcacatacggtcattatcaaaaaagaaaatgtagatttacattgtttgattgcgcaggtaatagatgaaatatacccgacactctctgcaaatggcaacacggcggtatttactgcggaggacaacttatctgtgaacgctgatcccgaaaagctggcgagagttttcagtaaccttttacgaaatgcagcgtcatatagttacccgcagacagaaatcactatatccgccaaacggttagagcatgatattcagatcacttttgaaaatcatggaaaaacaattccacaggaacagcttaacagtatatttgaaaaattcaatcgcttggatgatgcccggctttctaatacaggtggtgcgggacttggtctttctattgcggaagaaattatacatttacatggtggaaagattactgcatccagtcaaaacgaaaccatagactttgtgattacattaccactttccgcttaggaaaataagaatgtgatcttaggaattacttaggaatttaagcgtgtgatttttgagattgaaaagcctttgttcggtacaatgattatcgaacaagggctttttattgttcagctgaagcaaaagaaaggagtgtaagcatggaactgaaaatagagcatttaagcaagcagttcaaagacaaaacagcagtaaatgatgtcaatctgacattgactcccggcgtttggggacttttgggggcgaatggtgcagggaaaaccacgctcatgcgcatgattgctgatattatgacaccaaccaacggagcggtttactatgacggaaaagacattcgagagttaggtgaagtctaccgaagcaagtttggctttctgccgcaggattttgggtatcaccgggattttacggtcaaagattatttggagtatatggctgcgctgaaagatattcctacaagggcaaccacccaaaagatcaatcatttgttggacattctttcgctctccgatgtgaaaaagaaaaaaatctccaatctgtcaggcggcatgaagcgtcgtgttggtattgcgcaggctatgttgaacgacccggagatacttgtcatggacgaaccgacagcaggacttgatcccggggagcgcgtgcgtctgcggaatttcatttccgagttttcgcatgatcgaatcgtgttgatttccacccatatcgtatctgacatagaatatatttctacgcgcaacgcaattatgaaagccggagaaattgttgatgtcggaactaccgcagaacttgtcaagcggattgagggcaaggtttggaattgcataattccgacctcaaagctgccggaatgtgaaatgcggctgcgcattatcaatcagcgaggcgaagatcacaatcaggtttctattcgttatctgtccgaacattcggaaattgatggggctgttacaacggagccacgattggaagatctgtatctgtggttgttcccgcagacagacttggaaaaggaggacagataatatgcggctctttagacttgaactaaaacgtattttgaagtcacggcgcaccctgattttacttgcaatcgcacttttgctttccgtagccatggcatacctgcctatttcatttgagggtattaaccgtccaaacgaagatggcacggttacagaattagatggcttggcagctatcaagtacaaacaagatttatataaaacatccgctggtgaagtgaccccggataggatcaaatcagctttggaaacttatcaaagctgcgttcgagaatatgggccagtcgaggaagagggctttcctctggctgtatttattgaaaaaatcgtcccgttccgtcacttgctgatgggtctgtccgaagcgtttgctgatccattaacaggcattggtgctgatttaatggatattgacccgaatgacattgacggagcctattatgaaaagtgcgcagaacatttacaggatgtcatgcggaatgagcaaagagaaaacgaaaccgcacagcagaaagctcttgaaaaatattcagaacttgatacgccattttatcttcattctggaatttctaaagatgcatttgattatattgagttttatattttgttccttgctattttgtgtgtggcaatcgcagcatctactttcgccggagaatatcaaacgggcggtgacagcatcctgcgaaccaccaaatacgggcataaacaattagcaattaccaaaattctggcggcatttacacttttcgttgttactttccttgtcgggatcacggtacacattctgattttagatgcagcgttcgggacggattgcttaaaaacatcgtttcagatgcgatactctatcattaatctgccaaacatcaatctggggcagttgcagataattctcgcagcagcgggcttactttctgtattagcaacggttagctgtacgttgttcctgtctgcaaaatgtaaagacacattgacagttttgctgatctctattgtagttcttctcatgccgctttttgcatatgtggcgatgggagcaacatggctctctaccatacttccatctgccggaattggtatgcagaacaatttcctttctcagcttgcagatttcaattatctgaatatcggtggaatgagtttctggacaccgcatgttattttgatttcggcaggaattgaattatttgtgtttacattcttggcgattcattcctattgcagacatcaggtagcataaaggaagttcaaaatagaatgaattgattatctgccgcatgacggcaaaagaaaaaaagccgtcgtaaagcagccatatcaatacgcccatttgaaacggcggctttgattttcagagccgccgtttctttgcatttacacaaacctatgatgaattttccggaaatattgtggttaatagcgatttaaactgttgtatttgtttaaaaattaaaaaatatctcatgagtcttccgcatctacccacatctgcaaatttccatcaagatataattttgcatattcaagaggttcatcaatggcgagtgcgtttaatgcacagtctgatcctggtgtggtttttaagttctttttagcttcccaacagtcaatgcggagcatatagccaacagaggtgtaaacatcaatactgttgcgcttgggagtgtattctgcaaatattgttctcatcgtatcaaatctccttatcgttaaatcaatcatttgttgcaaaaatcagaagcatttcaatcagttcaccatgtcacttttattttgtgttatactgttttatataattttcttggtctccgcttcgctacggtcggtgcaaagcggacatccactggatgtcctgcacccttgtatttgcccttatcagagttcgtaaacactggtgggacgatataacacaagggaaacaataagggaaagctcacctgcgacaaatccagtgttttcaaggacctgcggagaatttaataacataatataacagttattataatctcttaaaacaggtgaaatctcaatcggaatttggaaaggggtgcactgccatgctgagaaagttgaattgttttttaaacatcgttattggttcattcataggaatttttattgggtacggaatttataagttctggcactttaaaacttatccaaatttatatgccatgcagtctgcaccgtggtacacagagttactgttggatggtgcaatggtggtcgttgtggtggtcgtatgtattatcctaaagctgattatttggaaaaagtgaaagccataacttcatattttagaaaggagatggcaaatatgtggtggtctattggtggtggaatcataatctttgcgttaggtatgtttatcttcttaaagccgggcttaatatggaaattaacagaaaaatggaaatcttatcgtgcagatgaaccatctgagttctatttgaaagccacaaaaatcggtggtgctttatttgccctatttggaattattatgattatgcttccatttattttggagtgacaatttcaagtttgtaaggaacagaaactttgaagttataggagattaaatatgatttggcaacaggatatacaggacgctatttttaaacatatagcagaacaaatgaaatgtagtgtagatgaattacattctggtgaaactaattttatcatggacgaaactgtttcaaaacgctatgtaaaaattcttagtgtaggtgatacaaatgttgtaacagtatctaaaaatatttattcggaggctatgagatgccttcgtggaaaaaacagagatgagttgtatgagagcgattttgtatttggtcaaacattgcattatgttccggatttaagtcaaatgaccatattaccttatactaatgattttacatttgaattactggttagtgatgaaattcaaaaattgcgaggaatacatggtttcgataattcattatcatttgacgaagatggtaatactacgacatgtattgttctatatgcaaagagaaatgacgaaattgttgcattagcaggagcctcaattgtagatgatgacttacgtgagattgggattgatgtaaaaaaggagtatcgtagaaaaaacttggcttcattattagtacataatttgactattgcaataatggaacaggataaaatcccctttttatagtgcttctgtaacaaatatagcatcacaggcagttgcaattcgtagcggttatatgccattatggacagatacatatggaactagaggtatttgttgataggaagaactgataacaaggtgaaatttcagttgaccgagttctttagaacgaaggattggtggattagaaagtgtcttttacaggaaggggattagatgaatgatcaatttttacaaggggtaatattcgattggaatagaattgataacgatagttatttaaggagaattaaggcttttaaggggattcaaaaacttgatttcaacaaagcaatcaccttttttgtcggagaaaatggcagtggtaaatcaactttattggaggcacttgcggtagcacatggttttaatcctgaaggtggaacaaagaattatgttttttctacgcatgatacacattcagagctgtgtgatgcgataagaatttccaaaggttatcggaaggaaaagtggggttattttcttagggctgaaagtttttataatgttgcaacgaaggaagaagaatatgcagatctcgcacacccttctgccaaatatcatgaaaaatcacatggagagagttttctcgcattggcacagaacaatctgcatccaaatggcttgtatctttttgatgagccggaagctgcattatccccacagagacagcttacattgttgatgcaaatatatagttgtgcaaaagagggagcacagtttattatagttacgcattcgccgattttgttaggaataccagatgcagatatctattgttttgataatggacgcatacatctgtgcgaatatgaggatacagagagctaccaggtaacagaaatgtttataaacaacaggcagatgctgttggatagattactaacagattagataataaagaaattgacaacttccagttgtgcgcccagctaagggtgtgtagtcaagccggtgggattccggtttatccaaggtttagccaaccagataatagcgagtcttgggatgatgccggtaacggcatctgacaagcgtagacagcaagaaagcagggttgaatagtgattgagcttcgaaacgttaacttcagtcggtcgacgtcttaactggtgtggaagccgagtagatgaaagcatagtgttaaatggtttcggttgtgcatggagattacattcttcatatacagccaaaagtttgataaggagcaagagaatgagtgatttaaaaggaatagagtataaacgatttgaagatatcaagcatatccgggaagatggaagcgagtattggagtgcgagagaattgggaccggcacttgattatgcaaaatgggagaattttgcaaaagtaattaaaagagcaatgatcgcatgtgaaaacagcgggcacagtattccagacgattttcccgaggtcaggaaaatcgttgaagccggagtcaccacgaaaccaaaaaaagattatgaactgtcaagatatgcatgttatctgatcgttcagaatggagatccaagaaaagaggtcattgcattaggacagacatattttgcaatccagacatacaggcaggaagttgctgaccactttaatgaactggacgaagataacagaagacttgttgtcaggggagacatcaaacagtggaatcaaatgttggcagagacagcacataatgcaggagttattacgaatgaggaatttgcaatttttcaaaatgccggatatatggggctatacggtggattagatgttgatgatattcatacgaaaaaacaattagaagtaggacagaaaattcttgattacatgggaagtacagagttgattgctaatctgttccgaatatcacagacagaagaaaaattaagaaaagataaaattgtcggtgcggaaaccgcgacatcagtgcattataatgttggaaaagaggtaagaactgcgattgaaaagattggaggaactatgccggaagatttgccaacaccggaaaaaagtatccagcagatagaaaaagaacagatgcagagattaaaaaataaggctaagaaaggcaagctgatgttggacgaataatccgaatggtattttattgttacatttggaattttgggtgttacaagggaccgtgtgagacttattgatggcagttataacaaaagagttctgattgttaccattatcaccaatattattgatgccgcattaacaattaatagcattgagacagttgtgaaagcagttaaatatagtcaacaataaaagagttttgtgaaatgtgtttaatggtgttaggcaccaaaaatttcgaaacaataaggaaaagctcaatcggaattgaccgagctgaaagagaaggatgcttgttgcccgaaagacaagaagatggaagtagaagaaaacaaaaaataattttttatatgaaaggctggttgcagaatgtcaaaacaaaatatttatgataatgatttattttacgaaaacttcgagaaaatacgtagcaaagaaatcaattttaatgatattattgagacaccaataatattaggaatgatacctgaactatataaaaagaaagtattagatattggatgtggtatggggcaacatgcacttcaatattcaaagaaaggggcgttatccgttcttggaattgatatatcggaaaaaatgttagcatatgcaagaaaaaataatgctgcctttaatattgaatacagaagactggcttttgaagaattggatgatttagaggaaaagtttgatgttattacaagttcattggcttttgattatgtagaaaattttgaaaggcttatgaaacagatttatagtcacttgaatgaaaatggcaaatgtgttttttcgatgtcacacccaataagtacagcatatgatgggacttttgacagatataccagaacagaaactggagaaagattatatgctaatctgcgaaattacggaatagagggtaagcgtgttattcattgggtagtagatgaatatgaactttatcatagaacgatttcaacattaataaatgatattgtttctgctggatttattattgaggaatgtcaggaatcaaaagtaccagaatcaattagagaaaagcgaacagatatgtttggaggagttattcatcagccagactttattttttttaggtgtggaaagaaaaattaatattttatctatgtaaagaacccgacaaattcaagtttgccgaaatatctggctaactttcccaattttacaggcattccagcccattcattagtgaaatgatatgtattttcccttatttttgcccttatgagataatcgtaagggaaataagggaaagttttatttagtcattgcctgccactttatcaagtaactttgcggattcccgcttggcttttcttgtagagtgtgcatagacattacagaaagtagaaattaagaaatttcctctgttttcttctttctgtattcatttggactcatatgataatattgtctaaacttccggcagaaatagccggaacttgtaaatccggtttcttctgcaatggaagaaaccgatttttgagtgatataaagttgttcagcagcctgtgctagtctgtattgaattagatatgctaccggagaacagtggatgccagtttgaaaaatgtgtaaagctccacttttgctgatagatgccgatgccgcaatcgtctccaatgtaatctcttccatgtagtgatcatgaatatactgcatcatagcttgtaatcttgcttgtttgtgatttaatcgatgaatacggttagaatcagaagtccagtccatatttttttgcaatatgttccaaagctgaaataaaagttgtatagtacataattcattatccggcttagtttcctgaatagtacaaatttgcgacaaaagttgtagtacctgttttccaaatgtgttggatggactgaaaacttgatatggaacagacgagcttatcacaggaagaatatatttttcgtaaatgaggctgttttcgggtgctaatagggttggcgaaaaaacaatattaggtgcaaatgtactgctttgtgcttcaaaacgatgcaggacaccgctattgataaatatgccgcaacctttatgtagttctattttacttgtacctataaggcagagcgcagtaccttcagcagtataaagaaattctaattcatggtgccaatgccagtcaatgcgatggaagtcaaatttccaaatattatcaggatagtatgcaaatggataacgattgttgccatgctggatggtttctcgtagtgtttcatctgtagttatcttaaaagtctccatgctatatttcctcataaataataaaatttgttatattgtaccataaatatatgattttatacaatgactagatataaagtttacgatataatcacatttattagagggggacaaaatgaaaagccaatataataagacaattacagcctgttttgtaggttatatagtacaagctatcgttaataattttacaccactgctttttttgttttttcagaaacgctatcatattccaatttcccaaattacattgttagtgacttttaattttgggatacaactactggttgattttctttctgtcagatttgttgataaaataggataccggatatcgatgattatagctcatgttctagcagcggcaggattattccttcttacagttttaccagagattttaccagtttcctttattggaattttgattgctgtaatgatctatgcggtaggtggtggacttttggaagtcttagtcagtccagttgttgaggcttgcccatccgacaataaggaaaaagcaatgagcctgttgcattctttttattgctggggacacgccggagttgtactcatatcaaccgtgttcttttatgtagtcggtatagataactggaaaatattagccattatttgggcggttattccaattggaaatgcttttgttttttcaaaggttcccattgcaccattgcttgaggatggagataccggacttggattaaagaatttgtttcggatgaaaattttttggattttgttgattatgatgatatgtgcaggagcaagtgagcaagcagtaagtcaatgggcctctgcttttgcagaaaaaggtcttggaatttcaaaggcagccggcgacttagccgggccgatggcatttgcggttctaatgggaatatcaagattattttatggtaagtatggtgaccgtatcaatttggaacactttatgatttatagtagttttttatgtattttatcctatttagggatttcattattctcgattccgctattaaatctgattgcctgcgctgtctgtgggctttcagtgggaatcatgtggcctggaaccttcagcaaggcatcagcagctttgcccaaagggggaacagccatgtttgcattgctggcattaggtggagatataggttgttcaggaggtcctacattggttggaatggtatcaggagcttttggggataacctaaagatgggaattttggcaggaattatttttccagtgttgctacttataggagtcattctttgcagaagacaaaagaaaattactaattataatacagtgaaaagtaggcactaaatatagttgcttattaaaataaaaaagaaagtgagaaaaaagatggaatttttaaaaaacaatcctaaatggatacgtcaaccaaagcaggtacaaattagtgaggataaagttgtaattcttacagaaaggggtaccgacttatgggcacgcacttattatggttttcaaaatgataatgctccagtatttcaagttgaaacaacggacaagtacttttcttttattgttaaaacagaattcgagagtacctgtcgttttgaccagtgtggtgtggctatgtatttaaatagtgataattggtttaaggcatctatagaatatgagaatgaaaaaatacagcgattgggaagcgttgtaaccaatcatggatattctgactgggcaacaacagacatatcctctgatattaaaagtatgtggtatcgtttttcacgaagggacagtgactactgtattgaatgcagtgaggatggcataaatttcagacaaatgcgtattttccatatgtgggaaggtgcagacaaaattacttatggaatatatgcatgcagcccgacagaaggctcatataaggcaacattttcaaatatgcagattacggaatgtaaatgggaatcagatgcagactggcgtgattgatgatatgatttctaaagataaatctcatatgagaatcattatcagttaaattgaataataaatataagccaaaaataatccccgaaaaattttagaatttttggggattatttaacattataaataaagagtgtcatctgcatccacccatatttgcatcgttccatcaagatatcattttgcatattcaagtggttcatcaatggcaagtgcgtttaatgaacagactgatccgggtgtggtttttaaatccttctcagcttcctaacagtcaatacggagcatatagccagcactggtatatacatcaatgctgttgcgttgtggattgtattctgcaaatattgttctcatcgtaacttatctcttcttatcgttgaatcaattatttgttacaaaaatcagaagcatttcaatcagtgcatcgaaaatatatttcatagattgacttgtaacgcaaaagacgttacaataaaagaaagatggaggtgtattctatgggaaaaacagcaacattaaatataagagtaaatccagatgtaaaagaaaatgcagaaagtgtattggcacaattagggataccaatggctactgctatagatatgtatttaaaacaaatatcattagtaggaggaattcccttttctattgtattaccaaaagcagctaattcagtgaatgcagatatgatgtctgctacacagattcatcaaaagttagaaaaaggatatgccgatatagagaaaggaaatgttgaggatgcagctagtgcgtttgtggcatttagagagagacattgatgaagcaatataatcgcattgctgatgaaatacttacattagacactttcccggaacgatttaggattatggattctgagccggaaaagagaatggagttgcgtagaatgctcgtcgataattattcagtgttttacacaatccgtgacgaaagggtaattgtaacggatgtgttatacacggcatctgatatagaagcacgtttgagaggcgagctataaaagcacgcgtttatttgaatttgctaaaggagatggtaaatatgtggtggtctattggtggtggaatcataatctttgcgttaggtatgtttatcttcttaaagccgggcttaatatggaaattaacagaaaaatggaaatcttatcgtgcagatgaaccatctgagttttacttgaaaaccacaaaaataggtggtattctatttgccctatttggaattattatgattatgcttccggttattttggagtaataaattccagttttgagaattgagaaaatcgatacttgtagatggaggtaatcaaaatgaaagaatatcaatatttgattggaaagattattgccgcagtggcaattatagttgccgcaatcattatagcgcaggctattggtggagctggagaaagtatccgcagtggcttgtttcaattaggggatgcgcttcggtaacttttgatttgttgaactgataaaaaccctttaggaactaaagggcgcacttctatactctcctgtcgagagtatcgtgcgtcctgcggagcttcattcccggtcagcagaagaaaactgctcgaccgagaatgtttcgtcacttcgttccgtcaaggtggctacacccccttgtgctgcttgtgcgtctatcccctgtggacttgtcttccgcaaacggttttggcaaaccgttcgccgccagcaagttgcaaaaaagtatgatggaggtactcaatttgaaaagagctgcaaaaatagttttgataggagtctgcttcggcttgattttgttattccttaaaattagttttaggattgatgatgcagcttttatgcatggttattggattgcggcggtagaaataactccaagcagagttccaactgttgccattgtaattccggaagtcagtacagataccgtaacattggaaacagtctccacaatactttcctttttactaagcgtctgtctgttttctttataccgttcagtaaacagaattgcataatctacagtggcacccagctggatggaacggataataaccttaatctgtgaagcttaaacggttatgatgctacataatgcttcccataagtgttgacattacaatcataacgattgaaaacataaatgaatcggctgccgttctccgccctttccaatctgaatgttcaaacaaatcagattggaggtaagggaaatggcatataaccatggaaaagcagagcgcaaatggaagctctggatttggattactgtttttatgcaactatttcttgttgctcttgacaaaatcatttttagagattaaaattataacagtgttatatagcgctgttatataggaggtgtgcaaaataaacggaaatggaacgactttagaaaatatccaccgggcagcgaaagcggaatttttagaaaaaggatataaagacgcttccctgcggaatattgtgaaatccgtgggaatgactaccggagccttttacggatattacaaaagcaaagaagaactttttgaagccatcgttggtgaacattatgaatatattcgtaaccgttttataaaggcacagcaggagttcgccgaactaccagctgcccagcagccggaagtcatgagtgatatttcgggaatctgcatgtacgatattctctattatgcgtacgaacatttagaggaatgtaaactgatcctctgctgttcggaagggacaaaatttgccgggctaattgatgaaatggtggagattgaggtagatgggacgcatgcctatcaggatgtcttaaggcagcttggacggtcctctccgcatatcgatccttcgctggagcatattctgatcaccggaatgtttcatactttttttgaattgatcatccacgaaatgccgctaaaagatgccgaaaactacgttaaagaaatgcgcgccttttatacagcaggatggatgaaaattatggggcagtaatgccttataatttttgtttgacagttagctacagctaacctaaatttggatattgtaagaacatagacgtgttctctttatcatagacacaaagaaaaggaggaattttttttgaaaaaaaaatctaatttatcacgcctgctggaaattgcaggcagccataagtacctgacctatgcttcctgggtgctttctgccatcagtgccctgattgctctggtgccattctattacatctggaaaatgatcaaggaagtattggaggtggcaccgaatttttgccaggcacagagcctgaccggtaatggctggatggcagtattgtttgcagttatagcggtgcttgtctacatagcagggctgatgtgttcccatttgggagcatttcgtattgccacaaacctgcgtatccagaccatggagcatattgttaagttgcctcttgggtttgccgagagttttggcagcggaaaactgcgcaagattgtcaacgaatccagcgcagccaccgaaacctatctcgcccatcagcttcccgacagagccaatgccattgcaaccccctgcggtcttttggtgctgttgttcgtgtttgactggagactgggactattgagccttgttccggttgtgctggggtttctgatcatgatggcaatgaccggaaagcagatgcaggaaaagatgaaagaataccagaatgcgctggatgatatgtccaatgaagcggtagagtatgtccgcgggattccggtggtaaaaacctttggccagacgatcttttcctttaagaagtttaaagactccattgaccggtataaaatatgggtgattgcttatacaaagcagcttcggacaccgatgatgttctatacagctgcaattaacggagtttttgccacactgatcgccggaggactgttgcttacgcaagagggtgtgacttccagttttttactggatctcattttctatattatcattacaccggttatttctgttacactgacacgcatcatgttccaaagtgaaaatgccatgatcgtagatgacgctttacagagaattgacagcgttttacatttgaagcctctggaggaaaccaaacacccaatgcacccgcaaaatgcttctgtggaactgaaatcgattcatttcagctatgatggagaaaaagaagtattaaaagatatttcactcaccattcctgcaggacagacggtagcttttgtaggcccatccggcggtgggaaaacaacccttgccaacctgatttcccgattctttgatccacagagcggaatggtaaaaatcggtggtgtcaatgtgaaagacatcccgaaagaggaactcatgaatacagtgtctttcgtatttcagaacagtcgtctgatcaaggcatccattctggaaaatgtgcgtatgggaaaaccggaagctacccgtgaggaagttctggctgcccttcatcacgcacaatgcgatgatattctggaaaaacttccacagggtgtggatacggtcattggtacaaagagtgtctatctttccggcggcgagcagcagcgaattgccattgcccgtgtgatgctgaaaaatgctcctattatcattctggatgaagccactgcctttgctgacccggataacgaaagccgcgtacaggctgctttttcaagactttccgagggaaagacggtgattatgattgcccacaggctttctaccgtaacaaatgtggatcagatttttgtcatttgcgacggacgggttgccgagtgcgggaacagccgtgaattgcttgcaaaagacggcattttcagccgtatgtggaaaaattaccagacttccgtgcaatggaaggtaacaaaggaggtgcagtgatatgatcaaaaaactgcagaaaaaatatgccctgtctgaacagggggcaaaagacctgatcaaaggatgcctggcctgtgtccttcagaatctgtctttgatgttcccggtaggacttttatattacctggtcagcgatctgatgaacgggggtgttcccggtgggaaaattccattttatgtggcaggctgcgtggtgtgtatcggcctgatactgctgaccactttctttcaatacaatgccacctattttgccacttacaaagaaagcggcatccgccgtattactctggcagagcatctgcgcaaaatccccctttcttttttcgggaaaaaggatttagccgatcttaccagtaccattatggcggactgcaccttcctggagcagagtttttcacattttatccctgagcttgcaggttcaatcatttctacgattctgatttccatcggtctgctctttacggactggagaatggcgctggctgccttatgggttctgccggttgcctttgcgattgtgggattttccgcaaagattcaggaaaatctgaatcagaaagccatggatgtaaagatggcctgcgcagacgggatacaggagtgtattgaaacggtacgtgacctgaaagcaaataatgcggagcaggcatatttaaaagggctggaaaagaagatccgtgctgtagagcatcgttccatcctcaatgaatttggtcttgctgcttttgtggtttccgcgtcactggtgctgaagcttggtattgcaacggttgcactggtgggagttgttctactcatgcaaggaagcctctccgtgcttacattctttatgttccttctggtagtatcccgtttgtatgaccctctgcagggcgcactccagaatcttgcggcagtcatcagtacacgaaccaacattgcccgtatgaatgaaattctcgatcatcccatccagcagggcagtgataggctttccaatcaggggtatgatattgtctttgaccatgttgggtttgcctacaataccggagaaaccgtattgaaagatgtttcctttacggcaaaacagggagaggttacggctttggtcggcccatctggcggcgggaaaacaaccgtatcccggctggctgcaaggttctgggatattaacagaggaaagattaccgtgggaggcatggatgtatcccgaatagaccaggaaacactgctttctctgtattccatcgtattccaggatgtcacactgtttgacaatacgattctggagaatatccgaatcggaaacaaagacgccacagatgaacaggtcattgcggctgcgaaacttgccaatgtggatgaatttgccaaaaaactgccggatggatggcataccaatatcggagaaaatggctgtgaactatccggcggagagcgccagcgtatctctattgcccgtgcatttctgaaaaatgcgccgatcattcttttggatgaagcgactgcttccctggatgtggagaatgaaactctgatacagacagccctttcccgtctgatcgcagataaaacggttctggtcatcgcccacagaatgcgtaccgtagccggagcagataaaattgttgtcctttctgatggcaccgtggcagaagaaggatcaccaaaggatctggaagaaaagaatggtgtatatgcccatatggtaaaactgcagacagaaagccagaattggaaacttgcgtaaagaaggaggaagcttttggctcccaccgtcgggctgccatgatgatgctggggtcttcccggctgcttgtcggcagaaagtaatgtgtcaaaacaggaggtttggctatgtccaagttaggagtcgtggaggataccctgtttgtccctaaaaacaatggtgcctgacacaataaagaagattttaaaatgataccgggcagaggtgtggcagcaaaggtggaaggttatcatgttcttgctggaaatagggctatgttgaatgaaaataacataacgtttccacagcaaatgacaacacaggcggaagaatttattaaccggggatgtaccatgatctacatatctttggacagccttttcattggttatgttgtattgtctgatacgatacgaagtgagagtgttggtacaataaaggtattaaaagcattaaatgtacagccggtacttcttaccggtgataatgaaaaagcggctgcttccattgcaagacagcttggtatttccgaaattcaagcaaactgtctgccggaggataagttaaaatacataaatgaatatcagaacagacaggaagctgtctgtatgatcggggatggaatcaacgatgcaccagccttaaaggcggctgatgtcggcattgctatgggcggtgtaggaagtgatattgctgtggatgcggcagacattgccctggtggatgatgaggtaaaggaattgccacatttactggcactttccaagcgaatgatgactacaataaagattaatatgtcattttccatgggacttaatttcatagctatcattctggcaatcacaggcactcttgatccggtcataggtgcattggtacataatgccggctcagtgcttgtaatcacaaattcagcattgctgttaaaatggaggaaatgtcaactttaaatccggaacatagagaggggaattatgagtaaaggaaatatggaaattagaaaaagcacaagagaagatattgagcagattatggctatttttacaactgctaaggagtacatggctgcacatggaaataaaacacaatggggagatggataccctggcgaggagatactaaaaacggatatagatgcaggaaacagctatgtaattgtaaataatggaatgattgtgggaacattttcttttattattggagaagaaccaacttatcaggttattaaaaatggaaaatggacagatgacagactctatgggacgattcatcggttggcatctagtggaatagtaaaaggaattgccagagcatgttttgaatattgcataaaacagatagactatattcgcattgatacgcacaaagataatatttctatgcagacagcaattgagcgatttggatttcacaaatgtggaaatatatatgttaaaggtggcgcggaacggatagcatatgattacatttcataaaaaacaatggtgtctgacacaataaatatgaatcataaagctgacttgaaaaagtaaattccagtgcaagagtaaattccatcggcttttaaattttgctgattttgcaggagtttttttaacaaaatctcttgctttctgttataattaagctagcttatcgaaattttgttgtttttatggcatgaaaaacaggctactggaattcggtgtgtcagactaaattccaccagccacatttaaaaaatgtgaaatgtttacttccagtctgacagaacaattggtgcctgacacaataaacttgcaataggctgcttttttctgttgagcaagaagtatcttttaattcatatttaggtggtttgtcaatagcaataatatttaatgcataatctgatttaagagtgaatttcaaattttagattttcaataatcatgggataaaaataacagggaggattatagttttcggaataaagccgatatataatattagaaacaataaataataaagaacggattcagagaaggaggacaaaggatatgtcaatgaatgtgaatacaacgggtactgtttatggaagttatcagaatacctacaaggcaggtacagtagataagaaaaaagaaacagcgaaaacaacagaaaatgataaggtcaagaaaaatgtgacagaaagtatagccgaaaaaaatctaagtaaagaggcacaaaaaatgcttaaagatatgcgtggctcaagaacagatatggactttatggttgcagattttgaaaatggtgataatgctaaagatattttagcacaaagtgataaagagtttacggttattttctcaaaggaagaaatggagaagatggcatccgatcccaaatattatgctgaaaagatgcatagtattgaaggtgctttgcgtatgtcggatgaaatcaatgctcagtttggatttgaaagagcatttggtaagacaaacggaatagaaaacagtgcagatactgatacaaaaataacaaagtttggtatttcttttaatagtgatggaactacaacattctttgctcaattagaaaaaacatcagctagtcagaaagaatatcttgaaaaaattcaggaaaagaaagctgcggagaagaaagaggcgaagaaaaaggaacaattaaagcaaattgaagtaaaaaaagctactgttcaagcaaattcaaaagatgaacttttggataaaattaaaaatattgaatggaattctatcaaaccagaggataataaaatcggtggaagatttgatttttcaatttagtatatttagatggggatgattacataaagtatgtaggtagattcattatgagaaaacgttttttttctattattgtatgtgttgtcatgctttttacaatgaatgtcacagcttttgcggcagaaactcaggaaaattattcggagacggagaaaacaatgacatttgaaataactccgacagcattaacttctggatcatcacgacattctgttggaatgttaaattccttttttggaacaaatgatacagtggcaacttccgctcttggttcttttacaatcagcagcacatctgttccgtcaggctccacaatcagtaaaatagtggttacatccacaaaaagtagtggaagtagtggaaacatcgaattatttgttgctaaagatgaggataatggagatggcacatttgacagatatacagacagcaaaagttggaatagttctcttacttttgcagattttggcaattataatttaagccctgttggaaattattatgttcaatttgaatctacaaggtattcaacgggaactgttgcagcagcaacattaaaaaatatttatgtcacagtatactatcattaaaattttataatccccattctaaacaagcaaagatgttgttattcagttagcagcatctttgcttttaattgtataattgatatgactattgagttagaatgacattgatagcgatagaaagctatatattacagaagcagactttgataaaaaagcatttgagagattatataaattgaatattatataatcagaggtatatagaacatgcacagagacactatatttcaatatgaaacaatggtgcctgacacaataaaaacgcatagccaaacttcgctcggtataactgcctgattgtgtcgaaattcgtattttatcaattatatctgataaaactggatttgcggtattgaaaatcagttatagccgtggtaccatatagacagtttcagaagggaggctggtctacatgattaaacgagaaatttatatgagccgtatccgtccttttatcggaaatgagctgataaaggttctgacagggattcgccgtagtggaaaatctgtcatgctgagcctgatccaagaggaacttgcccaaaacggggtccaaccagaacagtttatttccctgaattttgagaacatgagcaatgcacacctttgtacggctgttgcattgcatgatgaaatccttcgcagaacaaaagaaatcagcggcaaggtttatctgttcttcgacgaaatccaagaggtggctgattgggaaaaatgtatcaactctttccgggtggagctggattgtgatatatacattaccggttccaacgccaagctgctttccggtgagcttgccacttatcttgccggacggtatgtggagttcgtgatttacccgttttcattcagagagtttatggagctgtatcacaccgtttacgaaggtgcagacgaaagacaatgctttacaaaatatctgacgctgggaggaatgccctatttgagcaaccttcgctacgacgatgccgccagtcgtcagtatttgcgggacttgttcaactccgtagagctgaaagatattatcaagcgaaacaatatccgtgatgtggatatgctggagagaattattgcttatataacttccaacatcggcactaccttttcttccacagccatttccaagtatctgaaaagtgaagggcgctccgtttcaccagaaacggtactgaactacatcaaagcctgcacggacgcattcctgttttatcaggtgaagcgccaagacctccagggaaagaaaatcctgaccgtcaacgagaaatactatgttgcagatcatggtgtccgggaagccgtgtacggtggcaacatgaaggacattaaccttgtccttgaaaatgttgtctacatggagctgctgcgccgtggttattctgtgactgttgggaaagtctctgacaaggagattgacttcgtatgtgaagatcatgggaaaaagctgtatgttcaggtttcctatctacttgcctcggaggaaaccatccagcgtgagtttggggcgtttgccggtgttcgtgacaatttcccgaaatacgttgtaacgatggacgaactggatatgagccgagatggaatcaaacaccgcaatattcgtgacttcctgctggcagaggaatggaactgaaatgttcttctttcaccagaagatatgcagaagttcttccaatgccgagaatgaaaaaacaatggtgcctgacacaataaatattatgatatgtctgtatttaaccgctgtatagaaaccgggaatgttctcttaatactggaatgttggcaggatgtccacccggcgcttgtcagtatcccagtgaaatgggaatacagctcgccgtatggacttttgtatgctctgaatccgccggatgatgttatgcagtttgaaaacaatggtgcctgacacaataaatattctttccggaattcttgcagagatgggagacatttcgagatttgatgatgttaaggaaatacaaaaattaagcggattaggtcttgtagcatgtagctcaggaaagcataagggagagaccaaaatcagtcacagaggacgcaaacgactcagatactggttattccaggcggcaaagtcagcagtggctcatgcggaggaagttaaagaactccatgtgtactacacgacacgccctgacaatccgctgaaaaagatgcagtcactgattgtgatagcctgcaagcttttgagaatcgtttatacgattctgaagaagggaacggtctatgatccgaagaagatgctgatggacatcaggcggccggaaaagaaggaagcgattgcagcataagacaatcgacagcattatttattccagagccttgccgggttgcggatgattccgaaatcgggcagggttctggaaagaaacccgataacgatggagtgcaacaagcactgcatcagcacaatgaccagcaggtaacgaaacaagggaagcgtccacggaatatccgtaccctgcggaaagggcaggtcagtaaaatcaaaatataaacaagagctgtagcctgcagtagttcactccgtagggcaatgaccctgttagaaagcttagcgggcactcggtgtatgagcaggtgggacgaaggaagttggtacacgataccattagacacggaaggttcaccatcatagttaacagaggatttatagcctttataaagcaaaacaaagggacgctttataaactgcaccctcttctaactattcagtacaagatacaatgactgtcatacacttgtggctctgttttatgaggtaaatatttaaagaaaagcctgaaaaatcagtgatttaggacttgacattataggagacttcctgtataataaaaagggaacttttacatatcttctcggtttacgaaaaagatcacagtcgtcaagtccgaaaaagatgcctataagcatgtgcttaaggcgatgaaaaagcgtgattacagcactagctattatgcggacggagcggtgtattacgagacatttgtactcgcattgcagcatcatccggagtacaattatagtctggtcatctggaagagtaccgatggaacatttgattaccgggcaggtaatgacctgagtgcggcgcagatcacgggtaaaataaaacaggcgaatgcaaaggcgaacgcgattattccccggattatcagggacggaatgacgcgcaaacagaagctgcgtgcgatccacaattatctcgtgaaaaactgtgtctacgatgagaacgtgcgcagatacggatatgatgatgcctataccgcatatggttgtctgattgagaaaaaggcggtatgtcagggctatgcaggtgtttttaacctgcttgccgcaaaagccggcatctgttcgatcgccgttccgggtgaagccggtggcggatcacatgcgtggaattatgtgaaagacggaagcagctaccgctatattgatgtgacctgggatgatccggtgcaggatcagggtgcgaaggctgccgtgaaatagacttatttttacttgacacaggcacaatttgaactgacccacacatgggataaggtagagaatgctttatagagtcggcggaaatttatttacgggaatacataacagatgaaagggaggatactacttatgaaaaaacagcttacagcacttgttttatgtatttgtatggtattgtcggtgctgccattttcaagtacacaggcagctgcagaggagacgagcagtgttggcacaagcaatattagcatcggagactatatcaggctgggaaactataacgggcagccaatcttatggcgctgcgtcgatgttgatgagatgggaccgctcatgctctccgatcaggtgctggcaacgatggcttatgatgccaaaacaagtgaaaacagcgctacgcgttcgcacagccgtaacctaaaacgtgggacatatggctcaaatcaatggcgtgacagcaatatgcgttcctggctgaattccaaggcggaagccgggaaggtagaatggctttgcggaaaccctccaaagagtggctttgtaggagagaatccatatgaccaggcagcaggctttttaaacggctttaaggaggacgagatcgcagcgattaaaacggtaacccagcgttcgatcgtatcccatccggaatataatgcgggaatgatcgaaggccagggggcagatctgccttatgacacaaatatagaagcagccgctaacggatttgatcaggcctattatgagaacgttacggataaagtattcttaatggatgtaaagcagataaacaaagtctatcaaaataacagccagcttggaggcagttatcatattgcttataagggtggcgtgaggtggccttactggctgcggactccggtgacggattgcaaccacgatatgcgctatgtgaagacggatggaagaatagacagaaacgctccgtatttaggcttttatggtgtccgtccggcgttttatcttgatacgcaatattatcaggtgactggtggagacggtacagctgattccccttaccgcggtgcagccgtaaataaaccggaggagaactttacagtttccggagatggaccaacaccggggcaggagtgggatgtttcgcttgacaagagtatacagttatatcttggaccgaattattccaagagcaagaaatacgaatctgccacgatacctatccaggtcatccagaagacgcgcagcgataatgagaatatggttgtcgtcatctgcggtgaaggttacacaaaaggcgagcagcaaaaatttgttgcagctgccaaacggttatgggaaggcgcgatgcagtatgagccatataagacgtacaaggatcgcttcaatgtatatgcattatgtacggcatcggataaaacgtacagtgccattgatggatatgacagtacatttttcgatgtatggggaaagaatatatccgtgaatggaagtcagtggaagaaccatatttttgaacggtgtatcggaccggcgtttatcgagaaagtgcatgatgcccatattccgcagcaggcagatccgaatgtagattgggattttgaaaagtataaatatgtacatgactacatcagccagttcgtacttctggtcaattctgcaaatgattttggcggggcattcaacgatcttgattacggattccattatattgtcagccctgcatacagccagcgtgcagtcgaaacgcttacgcatgagcttggtcatggtctgttatggcttggagacgagtacaacagcggatcttttatgggagaagcgtctgaaaaaacttcgctaaacagaacggggatcagtgatcctgaacaggtaaaatggagacagctgcttggcttccggaagacatacagtgttcctcatacagattatgatacggataagatttataattccagccgtgaatgtatgatgcgccagacctggaatggtttctgcgaggtatgtaagctgcagggaaataagcggatgcgccagctggtcacagagggtccggatctgtatgtggcagaaccggaagtgacaaagcgcacagatgcatatacgaagctttcagattttagtgatgcaaccggttggggttatacaaaatttgacgcagacaaaaagacacgccttttgacaggggcagataaaattactttccaaccgacagagatgaaggggcagaagattgagctgcgtacaatcgtgcagaacctttccgatacaaagctcagtcaggtgacattacaggtatgggtaaaccatgctgacggaaccattgctactgctgatggtcagcctgtagcagcgtcagaaacgttcaagattccgctttggacggaaaagggcaatttccgcccgaagggaacgttggaatatcatggaagcgattttaattccggtttgaaaaattgttccctcttatataccatcccgtccaatgcagatctgcgaaccggtgacacggtcggatatgcagtgagggatgagcagggaactgttcttgcttacgaaggaacgcttccaaacaaaggtcaggatatcttgccggcaccggagcctgcaaagagttatacagttactttttgttataatgacggaagagaaaatacaacaaaaacgaccggaatcaatggaaaactcggtgatcttccggcaccggcccgtgaaggatatgtgtttgacggatggtatacgacaggtggtgagaaagttgatttgacaagagtatatagcagcaatacggtgttgtatgcaagatggagtgaatatatcgcaccgtcaccgaatgttaagaaagctccggtcattctgctggcgacaagcccggatacagtgaccgaaggagaacaggtcatgttaagtgtcagcgaaacctcaggatttggtgtggatttaagcggagtaacttacacggcagatccttcgctgccgatatccggcacaggggaggctcagacgatccggctcgatcaagctggtacttatacatttactgctcattattccggtgataatgagaaatatcttgcggccgacagtaatcgtgttaccgtaaccgtaacgaaaaaagcggatgtcagcggaggaacaacgtcaggaggtggatcatcgtcaggaggcggttccacggcaggaggcggatcttcagcaggaggcggatcttcagcagggggcggatcctcgtcaggaggcggtgcagcagcaggaggtgccaccgcgggaggcggcgcagctaacggaaatgcatctgcaacaactacgccggacatcaaggattcggatggaacgactgttgccatagtgaacggtaaaaaaggaatgatcacagcagaagtgcagcttagtgaaaaggcgatcgcaaatgctgaaaaatcaggtgaagcagttaaacttccggttgaagtaaaggcaggtaaaaatataaaagctgcatccactgtgaccatcaatctaccggagggtgcagggaaaacgaaagtgaagattccggtaaaaaatatgaccgtaggtacagtcgcagtgcttgtcaatgccgatggcactgagaaaattgtgaagaaatcagtggctgcaaaagatggagttcagctgatcgtggacgaagacactacagtgaagctcgtagataaggcgaaaaactttaaggatacaaaaaaacattgggcgaaggattccattgattttgtaagtgcacgcgggctgatgaatggaaagagcagtacggcttttgcaccggaagcaaaaattacccgggcacggctatggacgattctcgcacgatgggaagacgtagatctgacaggtggaaagaagtggtacagcaaagcacgtgcatgggctaaaaaccagggaatttcggatggcagcagaccaaatgctgcgataacgagagccgaggcgatcacaatgctatggcgtgcgcaaggaaaaccggcagcagagcaagagacagcttttaaagatgtttcttctgatgaatactacgcacaggcagtggcgtgggccaaagagaagggtatcgcacaagcgaatagcaaaggacgattcaatccggatgctgcctgtacaagagcggaaatagccgcattcctgtatcggatgtcgttgagtgaataaacggtttacatgtaccatctggtataaagatagcaggaaggagatacctgatttgaaaagaactgcaaaaatcattttgacaggagtctgcctcggcttgattttacattgatttaatcaaaaaagaaaaatggacgatacagagaaatctgtatcgtttatttttcgtcttttttaatttataggaaagttctaactttgggatagctagatatgaaaagggcccgcaatttagcgggcacgacaagtaaacgataggttttagaagatatagaagccttcagctccaggaaagtcttcaccaaactcatcgtcttcatttaagaagtaatccatatcaagcaaatcatcctcactcatgtggcggatgtcatcagcagtcatgccttcaggtggattctgtatgtacttgtttctgatttcatctgaacgttttgacatagtattttcctccgttttttacattctatcacagaggaaggtgtgatgtatatatttatgctgatgaagtatatgagagcctgcccatagcgttactgttcagaccattgtaaaaactgacgaaatttaaaaaaatatatttgtggataaactcaagcaggatggaaagtttcgttaacgacttccgaatcctgctttttcttttgaaattataaacagtacctgcatattttcctgcttttacatggctggaatacggatttccagtcctgcttctttcatttttcttccggttatccaccgtcattctgccagtcccggaattcgtccgatttcccattcgtccctgtttttgctgtacttatcctatacttaaggaggcacaaatgaacgcagatgataaaagcaaactcaaagcatatgaagaacttataggcagtcttgagcatacaaacggactgcagcacagggtcattgaaacccagtcctcattgatcaaatcccttgaggaacataatgcagaattagaaaaaatcattgatgatctgacaaacatttaaggaaaggacgcggcatggggatgggaaattcttttgaaaccattacagtacttcaatacaggctgaaagaagcacaggaagaacttgcagcctttcaatcgggagaaaaatatatccgaatggaaaaacagcaccttacacaggtgcgtgccctggaacgcagaattgcaaaactggaagcagctgtagcaaaagaacacagccatgccattacgattcggaatcaatggtttgagatttttgaacagctgcaaaaagaatgcgaccgtatggtcgccgaagcagtaaaaaaggcggatatgatggaaaaaagggccatccgtgcagaaagacagcgcgacactgcccttgaaaaagtaactttccagagacgggaactttacaaagtaaagacagagcttgatgatgaaaaacaaaaagtacagaaactgacggcacagattaaccggaactatgaaaactcatccatcccgtcttcaaaatctatcgcccgcaaaaaaatatccaacagccgcgaaaagacaggaaggaaacccggtggacagccaggacacagggggcactgcagaaagaaactcaccccgacaagggaaatctatcttcctgcacccgaagaagtactccatgaccctgactttaagaaaacatcgaaaaccattacaaagcagaaaatcgacatcagcgtagaagtgcatgtgaccgggtatcatgccgatgtgcactataattccaaaacaggtgaacggatccatgcaccatttccacagggagtcattgatgacgttaactatggaggaaatttacgtgctttcctgtttctgctgaataatggctgctgtacatcaattgataaaagccgcaggtttttgtctgatctgacagatggaaaaataaacatatcaaaaggcatgatcaataatctctgccagtcatttgcagaaaaaacagaatcccagcgcaaagagcttttccgtgacatgctgctttcccctgtcatgcatacagactgtaccaatgcccgtgtaaacggggaaagttcgtatgtatttgtatgtgcggttccggatggcggtgtgctctattttgccaggggcaaaaagggacacgatggaataaagggcacggtcgttgaagactatcaggggacactggtccacgatcatgatgtaaccttttataagtatggaaccggccaccaggaatgccttgcacatgtactgcgttatctgaaagacagcatggacaacgaaaaagaccgttcctggaacaggcagatgcattccctgatacaggaaatgatccattaccggaatggtttatctgaatcagaagagccagatccgcagaccgtctccgaatttgaagaacgttataaaacaatcctgtccatagccggggatgaatacgactatgagccgcatgggaaatactaccgtgatggatacaacctgtacaaaaggatgaaaaagtataagaaagatcatcttcttttcctccataataagaatgtacctgccacgaataacgaagccgaacggctgctgagaaaatataaaagaaaacaggcgcaggctgtgtcattccggagtccgtcaagcatcgaccatctctgtaaatgcatgagcatgctggttttgatgcgcagaaaagagcaggccaatctgttccgcgagattgcagaaatatttgcataagaaaaccgatggttttgactacgattagtctataccatcggttcttttgttacaagtttacctctgaacagtaacgaaaattccgcaaaggtccgtgatgatgagcaaagtggtgacagcaacagtatcataaaccagaagaaaatgctggagaaatatgcaaccgaacagggatttaccaatctgcttcattattttatattctgaaacgttcgaagcatgcgaaatacctgttccaccgtatcggtcatattctgttttgcatggtcggtctgcatggcatcttcaagcgaaataacgccccgcacaatcggaaaaaaggcatcaattcctgctgcatgacaggcttttgcatcctctgtcacgcagccggaaaatgcaagcacaggtttttgaaattctttggcaatctttgcaacgccggcaggtgctttccccatgacggtctgaccatccagacagccttctccggtgatgacaatatctgcattttttatatagtcggaaagatgggtttcttccagaatgatgtttacaccggattccagagtggcatggaaaaaggtgagaaaagcaaacccaaggccaccggcagccccagctcctgcatgcgcgggattcgtttccggaaagctttttccggcgagtgcggcataggaggaaagccactgatccatctgctggatcatggcaggatctgcgcctttttgaggaccgaaaacggcgctgcatccctgcgaaccgcagagcggatttgtcacatcacaggcaatccgaaacgtacattctttcagttccggcagcgcatgggagtctgaaattacagccagatcctttaagcccagagcaccatgacgtaccggaaccccttcctgatccagcaggtcaaatcccagtgcctgcagcataccgattcctccatcgtttgtggcacttccgccgattcctataataaaatgtctgcagcctctggaaatggcgtctctgatgacttccccaaccccgtaggttgttgtatacaaaggattccgttcggtttcggaaaggagtgtaattccggcagctccggacatttcgatgactgcagttttgccagcatccagaatgccgtaactgcaaagcaccggtttttcaagaggcccggttacgcatacctgtgtgcgtgtgccgccacagccaagcgtcaaagcttccaccgtgccttcgccaccgtctgcaagtgggcggatggtgatatctgcatccggatatatgcgccggattccggcagaggcactctccccggcctcaagggaagtcatgcttcctttaaaagaatcgatggtaataacaacgttcatgtatactctcctcctgatatctgatggttgtattacatgtcaccaggcggaaccggatgacatgcttcattataacatgaaaacagcggagtggaactggtgaataaaagaagtatgcatattatttgacacgcgtcaaatgatattagaagttatatttgacgtgcgtcaaataatataaaagagggagaagtgctgcacgcgatgtggtaaatgatgtgaaccgctgcaggggtcgggcaaagcccatatctttcatgtcgtacgaaacccaaaccggtctgaaactgatataataggtacgtaggtcaggaaagttccaataaggaacgtaccttaaatcaatcagtacagaacatctgatttatgcaccaaagtcaggcagcagttcccagaaatttgtatttcaattgattaaaagcgagacataaaaatactgaagtgaaaaaataaaatgtggttgcaacaacatattcttttcccatttttgtgtatattgtaacggaagaatgaaaaaactgtttgtaagagagtctatataaatgggaaaggataaaatcatggaacacaacacacgggtagaacagatcaaaacatatctggagcggctgagcgccggggaagaattggaaaaagtaagggtggatttcgcaaaagaatttaaagcggttgatccggcagagattatgcaggcggagcaggaacttctgcagggtggcacaccgcttgagaccgtgcagaaattgtgtgatgtccatgcggcactgttccgcggcgcaacgagtgaggaaaaagttgccaacgcggaaaaagcggttgcggcatcggtaaaagagaaaaagctggcggctaccgcggctttaaccggaatcaccggacatccgctgcagacgtttacccacgaaaatgaagtgttggaaaacgtcatccgggaatgcaggaacgaaatagagaaaaccaataccctttcaccggagcggtttggaaagctgcgggaagttgcgatccattatgcaaagaaaggggatcttctgtatccacacctgaaagtaaaatacgggatcagcggtccgtcggatgtgatgtggacaaccgatgatgagatcagggatgaactggcggcactggcaaagcagctgccggttcaaaagacggaagatcactggctggaacgttttcgcattgtgttgcagcgcgtggaggatatgatctacaaggaagccaatattttcttcccgaactgtgccctgaatttcacggaggaagagtggtttggaatttaccgcgattcgaaagattatccggtctgctttggtgtggaaaatgcgacatgggaggcggcagagaagtatctgcatacagaaaattgcagtaaagatgtaaggaatggagaaatcatcatgccgggcgggcacctgaccgttgcgcagcttaccgcaatgctcaacacgattccgatggagatcacatttgtcgatgaggacaatatcaaccgctttttcaatgaaggaccaaaggatttcaagcgtccgggcatggcgatcgaccgtgaggtattttcctgccatcccccgaaagtggagcagcaggtgcggcacattatcggggaattccggaaggggacgctcgacaaagtgccgatctggatggagaaaaacggaaaaaccatgctggttacctatatggcggtgcgggatgccacaggcacatatctcgggaccatggagctggtgcaggatatgggctttgcaaaagagcatttcctttccgacgtaaaagcaaaagaagcagcgctgcgcgcaggtatggaagattaacttatttttgtttttccatatgatttaattccggaatcacggtagcaagcatcgtgagaaagcacaggcttccaccgatcacatttgagaccggttccgccataaacacacctcttgttcccatgccaagcgcatatgggagcaggtaggtcagtggcacaacaataaatactttacgaagcagggagaaaaaaattgcctgcttctttttatttaatgatttaaacgtggtctgtccgatgtattgcagatccatgaaaataaatgcggcaaaataaagttttaaggcaggaaccgcgtctttgatcagctcgctgtcagaactgaaaatcccgataaggaaatgcggtgcaacgataatgaccgaccacatgattgccgtgtatgcaaagatcatagccgccattgtaccaattgcctgttttacacgtttcgggcggcgtgccccataattgtagcttaaaatcggggaacttccctcattcatggcataaatcggcgtctcgacgagctgccggacgctggaaatgattgtcatcacggagatatagatatcgcctccggtcacggagagcacattgttgcagcagatgctgaccagactgttggtaagctgcatgataaaaccggcagtaccgagacttacgatgttttttgcattttctctacaggtggcaagttcggttcggctcagaagccgtactttaaattccgcgcgtttttttagaaaataaagcacaaatattgcagagagcgcctgtgagattacagttgcgatggcggctccacggatacccaattgcaatacaaagataaagagcggatcaagtatgcagtttgccaccgcgccgatggcaacggatgtcatgccggtcatggcatatccctgtgcgttgataaacgaattcataccggtagcgatcatggacggcagtgtgccgaccagatagatcatcaggtacgggtatgcataaaccagagcagactcggaagcgccgaacagacgcaggatcgggcgcgcaaacaaaaatccaatgaccattaaaacaattgcgccgccgcagaccatcgtataggaggtattcataatttcggaagctttccgggaattattttccccccgccggatggaaaaaagcggagcaccgccgctgccgaacagattgctgaaagccgtgatgatcacaataatgggaaaacataagccaaccgcgccgagagcggttgtgccgatatgcgggattcttgctatataaatgcggtctatgatgttgtaaagcaggcttaaaagctgcgcaaccagcatgggaatcgctgcgtttaagatgttgcttggtatggaaccatgttcaaaatcaattcgtttcattttttccttaaatccttttctttctgttgacatttagtataccatgaattaacatatatgaaaaatattacttttatgtcttaaacaaataaaaattatataaggagaagctatggatgtaaaacaactggaatacttccgggcaattgtggatgctggtacgatcagcggtgcggcgcgcgttctccacatgacacagccgccgctgagttatcaggtaaagatgctcgaagaagaacttcaggtgcagctttttttgcggggcaccaaaaagattacattaacggaagcaggaaaaacactgtatgacagggcgggcagtcttcttaccatggcggatattaccaagcgggaagtcataaaggcaagccaggcggcaacaatccacatcggatttacgccgtccacggtttctatgatgtccgattacctgatccgtttttccacgtcgcatccggatattcgctttgatatccacgagggatcgacatttacgctgcgagagcagttggaaaacggcgtggtcgatatcacgacactccggacaccgattgtgctcaaaggatgtgagagcaggactttgatgcaggaaaagctgcttgcaatggcggctgcagggaacccagttttagaaaaaaacaaagatgggatcacgctcgaggaactgtcagagcagaaactgatcctgtcccaccgctaccgcagttacctgttgtccgcgttcgaaaaaaaggggcttttgtgtgatatttattgtgagtgtgaggatgccagaacagcgatgaccatggcggaaaaagggcttggaatcgccattcttccggcttctatgcacaagttgtcggatcagatgaagtcctgtgatattctggatgcggatcttacgacggaacttcttctcgcgtggcgaaagggacgcatgccggaggaagtgaaagcgtttcttgaaatgtggagatagaagtatcgtgcaattctcccgaaatttatccggtatgccatggaataatataaaactccgggcgcaaatgtatatgtgcccggagtttttaaattgtgaatttaaatttatcgccgatacataattgcttacatctttgaacaagtgagcaatcagtattatagattgtactctcgattcgaagaagtggataaccttttgaaatccccaaaatttttgattcctgtgcggaggcaaacacaatatctaaagttttgtcggaatgatcaaaaataatattgtggttttgcagcacatcataaagggaggtgtcatttaaattttctccaaataaaaaagaaaaggattcaggaaaccggttgatttctaacaataccggtttttcatcggcataacgaatacgttccaatacgagaatctttttatcgggtgtaatgtgcatgagttccatgtctttttcggtaggatcttctattgcaattttaatggttttcgcacctggaattgctcccattgtacggcacatttcagaaaatccggtaacaccttttgagatatttcgctggattcttttttcggcaacaaaagttccttttccggatttgcggtccagatatcctaattctgataaacctgcaagagcttttcggacagtgacccggctgacattgtaggttgtacttaactcattttctgttggaagacggctgcctgctttacgttttccggtgtcaatctcttcttttaactgatcctcaagttgtttgtatagtggtttggcaattgtattgtttaattccatgaaaaacctcgtaatgtgttttgatttgtattatacaatatattataatacaaagtttcagaattgtatatatttattttaaaagctgttttatattgacaaatgtattatattgtattatattttggatagaaacaaacgagacaaataaaaaaaggagaaatgaatatgagttatacaagcaaagacattaaaaacattgtagcagagattttggagaacaaaaaagacaaaggaggtgttaagagcctgtattttgttggttgtggagggtctcttggagctttgtatcctgcaaaaacatttatggagaaagagtgttcaaatattaaatccgcgctgatcaacagcaacgaatttgttcacagtacaccaaaagattttggagagaattcgatcatctgtctgtcctgccataagggaaatacaccggaaacgattgcagcagcaaagcttggtaaggaaaaaggagcagcagtaattattcttacatggctggaagaatctgaaattgtggagtttggtgactatattatccagtattcatttgatgcaagtccggatcatctcaaaggtgatattgattatgctggagaaaaaacaatgtgtgcgttgctcgtagcagtggaaacacttcaacagaccgcaggatatgaaaattatgataaattctacgaaggacttggtatgattaccggaattatccggaatgcaagaaaacatgtacaggcaagagctgaacagtttgctgaaacatacaaggacgataccgttatttatacgatgggaagcggagccggctatggggctgcatatatggaaagtatttgcatttttatggaaatgcagtggcttgattccagcagtattcatacaggagaatatttccatggaccgtttgaaatcacagatgcaaaccgtccgtttatgatccagatatcagaaggatctacccgtgaactggatgaaagggctttaaaattccttcatacatatgcaaagaggattgaggttctggacgcaaaagaacttggattatctacaattgatgcttctgttgtggattactttaaccattcactgtttaataatgtatatcctatttataaccatgaactggctgaaaagaaagaacatccgctttcaacacgtagatatatgtggaaagtagagtattaattcagaacatatttaattcgggcaaaagaatttataagcagacaaagacattgtatcctatgtttttgtctgcttattgtattatggatacaaaacaatacatatataatactgaaatagcccgggaatgaaaatgtgcacaaaaatcggaactaaaatatagaataattgacgaaaaacacacaagtccttgacaaaggtatgatacaaatataatattaaggcagatacaaaacaatacaaataagagcgatgtacgagaattgtattaaagtttgtattgtacggatatgcgcacatccaaaatgtaactgaaaaagatataaaagagagggaggacatgaatatgttctgggtagaattaatacttgtacttgccattatatttttgggggtacgtaagggtggtacatttttagcaatggctggtggtgttggaatgttaattatgacatttttctttcatgttacaccagcagatccgccagttaccgttattttaattatgattgcggtaattgtagcagctgcaacaatgcaggcatgtgggggattggattttctggttcgcatagcagaaaagattcttcgcaggaatcctaggatgattacggtacttgcaccggttgtagcatatatttttacatttatgtgtggtacaggtcacattatttacagtttgcttccggtaattaatgaaatttctattgagacaggagttcgaccggaacgcccgatttcagcatccattatagcttcccagcaggcaatcacggcatgtccgatttcagcagcaacggtaggtattctggcttttatggctgaagcaacgaactataaaacggttaatatttttacactgcttgtagtctgtatcccggcaacactgattggtacagtcgcatgtgcccttgctgtaatgaagaaaggaaaagaactggcagaggatccggaatttcaggctcgtgtagcatccggacaggttcagactcttgtgaaaaatgagaatgctgcagaagttaaaacaacaaaagaggcaaaaatctctgttgcagtatttttggttgccatggtaggtattgtattgcttggcgcagtgagtgcattagttccaacactttcagatggaagcaaattaccgcttaccacagtaattgagatttttatgctggttgcagcagccgtaacggtattaattacaaaacttgacagcaataaggtactggatcagccagtatttaaaacaggaatgtttgcagttgttctggcatttggtctttgctggctggtgaatacatttattgcagatcagtcatcgtttattacagataatatgtcagttctcacgaatgaacatccatggatttatatcatagcagtgtttattgttggggcaataacaacaagtcagtcatcctctacaatgattatggttccgattggtattgcattagggcttccggcaaatattattgttgctggctggattgcatgttcatcaaattattttattcctgcttccggtcagtgcgttgcagcaattgcgtttgataccgcgggaacaacaaaaattggaaaatatgtgttaaatcacagctatatgcttcctggccttgtatgtactgtagtttcagtagtgtcagcaattttgataggagcagtagtattttaaaacataaggagaaaatctatgaaagaaccaaaaattatagcgattggagataatgtatgtgataaatatttatctcgtgggaaaatgtatccgggaggacaatgtgtcaatacatgtgtatatgcaaaatggaatggtgtcaattcggcatatcttggaaaatacggtaatgatgaagtagctgaatgtgtgcaggagacattaaaaaaattagagattgatgatacgcattgccggcattttcagggagaaaacggtttcgctttggtaacactgaaagaaacagaccgtgtttttcttggctcaaataaaggtggaattgcaaaagatcatgcatttgatttcaacgaagaagatatggattatattcagcaatatgatttgatttacacaaatcttaacagctatattgaacaggatctttcaaaattgtatcagacaaaggttccgattgcctatgatttttcaatgcgctggacagatgagtatttgagggatgtatgtccgtatgtaactgttgcaattatgtcatgtgcacatttgtcagaagatgaacgggagagagaaatgaaaaaggcacagaaatatggtgtttctgttgttcttggaactgtcggagaagaaggctcttatgtattatataaagataaatttttatatacaaaagcagtattggcagaggatgttatagatactatgggagcgggagattcttattttgcggcattcctaagtgatatgttaaaaaattccccacaacataagattttagatggttcagatgaacagatgtatgtaaaaattcaaaatgcaatgaaaaaggcatcggagtttgccgcaaagatgtgcgcaaaagaaggtgcatttggatatggagtaccaattacaggaagaacagaaatttagggaggtataagtatgaaaccagatatgtatgaaaataacgaagagggaattttatgtgtctataaaaatccaaagtggcttgtatgtattaaaaactggaaaccggacaatgatattaatgggattaaacacttggagatccatcattcgaccgatgagcagtttattcttgtacatggtaaagcgattctgattaccgcagaaaaaaaggaaaatggtttttctattgatctgacattgatggagcagggaaaagtatataatgttccggcagaatgctggttttattcaatcacccagaaagatacaaaaatagtatatgtacaagattccaattgctctatggaaaacagtgatttttgtgatctttcggaagaagaaatagcatggattcaggaaaaagcatcacggctgctggcataactaaaggatagatttatatgaagaaacaatatattctttttgattttgatggtgttattgtaaacacggaacctcaaaatgcacattatctgcaggaaactctcaaatcgtttggtgtatatatgggtcacgaagagttaaaaggatttattggagttaacagccgtgaaaaaatattgcgttatttgagccggtcgaaagaaaatgtttcatgggaaatgtaccagaaaagaagaaaagagatgggaaatacctatgaaaatgatgccatctgtcccatgccgggattacaggaattatttcaatggatgaaggaacggaatctgaaagccggattggtaacatcaacgagcgcgaaatatattattacggctttaaaccggatcaaaatgacagattatttttcagttattgtatgtggggatatgtgcgaaaaaagaaagccctatccggatgggtacttaaaggcgatacagttattgcaggctgaaaaagatgaggttgttgcaattgaggattcctcaaccggtattcatgcggcaatacaggcaggaattgatgtgattggttatactggctcaggaataaaacaggatactggagaggcaactgctgttttttcttcatttcaggacattcagcattttttggaaacagcaattttataagtgtaccagcatacgttatatagcaggcggcagatgatttctgccgcctgctaagtttatcaatatttgtagttatagctcctctatgcaaaaagtctgccagaagaacaaaataggacatataaagaaaaaagggcaaaaatatccctttgtgtaagacaaatgggatatatggatgaaaaggtgcctgaaatgtcctgctgtgatatctgtatgggacatatagacaaaaagataataaaaaagtccttctgtaaaagtcaaacgggacatgtggacgagaagatgctacaaatgtcctgttatgacatttgtatgggacataataagaactttttttcacatatgtcccagctgacaggaaaagcaggacataatatacaaatttttctccatatgtcccggtttttcatagaatgcatattcataaaatatgaaaagtattatggacagaaaacatcaatgaacagtaagtatttgtaaaattatgaatagaatatcataaaggaaagcaggacaactgctttacattattcagaccgtgtgatatactatataaaattcaacaactgtcacggatatctgatgacaggcgtttgtcaggagttttgtatacagagaatacagactgcgcgttggcgggatattgccgatgcgcagtcttttttagtgatgcagttgaggagagaaacaggtatatggggatagctcgggaaaaaaagaagaaaacattaaaggcaaaaatgcttggcatattgacgatgtgtgcgatgacaagccttctggctgcgggaattgtatcctatatggcactgagaatgatacagaatgacagtatagagaataacatgaaaatgtatctggatcagattacgaagaatacggatgaagcctattatgatatgctcagtattgtgaactatatgggaccgggcggtctgatcggaaacgtaacggacagttatcttgatgctgtggataattttgacaggtttgttgaacagagatctcttagacaagaactttcgggactcggatatgtcaacacaaaactggtaggcgttacctattatgacaaggaagagaaaaaggaacttatcagcggtatgaatgtcagaacactggacggaagacagaacgcattgcctaaggttgtgaagtgtgcgggaaatgttatgcaggcagcccatgcgtctttttttgggaatagtgagaaaacagttttttccgtcatgagggaagtagtttttggcaatgggaaaagactggaaatctacacagaaatagaggctgatatgaagaccccggaagaaataaataaggaaggatatccctacacttatattcagatggatgagagaggggttgcacaatacagcgtaaatcctgtcattatgcacggacagaaactgttttctgcatcactctcaaagggggagtatgaagtccagacgagagagggctataagatcatggcataccggagtcagatgggatacattaatgcagtggcactgccggacaatatatatcagaagaagattaaccagtggagaatgatgatgacactcatcatagttgtaacgtttctgctcttttccatgtctgtcctctatctttatcgtatgatctgccgaccgctgagtcaattccgcagacagatggtgcagattggggatggcactcttcaggcagtacatgaagagtcggacattgcagagtttgacagcctgatgagggaagtagaacagatgaagagacagattgagaatcttatcagcaatatggtagaaaaggaaaaaagcatacagaagatggagtttgagaaacttctctatcaaattaatcctcatttccttctcaatacactgaattcgattcagtggatggcacaaatgagtcaccaaagagagatcagtgagtttgtacagagactaaagaagcttctttcctataatctgggcaaagaaggccgccagacaacgttgcggatggagttggagattgtaaaggaatatattgcacttcagcagatgcggtatgattttattattgagatgaatatagaagatggcagttatcttgaccagccaacggtccgtatgctttttcagccacttgtggagaacgcgatccgctatggtcttggggatgatgagaagatcagcatccaggtgtttgaagatgtggcaaggcatcttgctgttgtaactatctctgacagcggaaagggactgaatcaggaggagatagatgagatcaaccagccgtttgattatgactggggatactggaagaatgagaacagaggtatcggactgcgctacgtcaaggctatgctggaatcattttatgatggacagacgagtttgtttgtaaacagcaaaaaagggttcggaaccagaattacgatccttcttcctgtccggaaaccggaagaaaaaaaagagaaagacaaagaggttacattggaagaaaataaggtgggacagacagatgaaagtattgattgtagatgacgacaaacttgccagaaaaggtctggtcgctattatggactgggaaaagtatggattcgaggtagtgggagatgtacagaatgggagaaaagcccttgaatttctccgaaatcatccggtggatattgtatttaccgatatagatatgccggaaattgatggactggaacttatgcagatgtgcggagaggaatttccggaaattaaatttgtaattctttctgtatatgagaatttcagttatgcacagacggcaatccgtatgggtgcgttagactatatctcaaagatcagtttttccccggaagagtgtggaacgatactggaacgggtcagtgcaaagtacatgcagacatgcagagatggacatgcagaagaggaaaatcaggaaaaagttgaagaactgaacagaagatggatgcacaccagatggattttcagtgagaaagaatttgaagatctctgtcagaaaacaaaagaaatcagtctgcggagtgcggagaggatttttgttaagagttttcataacattcagctcctgtcagatgaagaaggggaatttccatcgctggatacggttgaagagatgctggactgggtgcaccgctggagggaacatatttatgaagagagtcttagctcatcacagaaaaatgatatcagtgcttttgcagcggttatcaagtatgtggatggacatatcggggaggatcttcgctctgaagacgtggcagaacggatagggatgagcaggagttattttagtacaaggtttaaggagatgacgggggaaacatttcaccaatatgtgatacaaaggaaaatgaagactgcggcggaatggatagaggagggaaagaagagcattacaaggattgccgtagaacttggatatgataattttcattattttgcaaaagtatttgcacgggagcatgggtgtacgccttcggaatacagaaaagagagtaaaaatgtctgattttcatcggacattttttttgtgataaaaaatatttggtaagattagaaacaatatcatctagcaggatatgggggaagaagataaaataattaaaaaaaggaagggaggtatcatggtgtatattaaacaaaaaggaagggaggtcctggaatgtatatcaaacgatttgtgaagcattattatattatgctgattccggcacttttatggctgtttttctttagcattgttccgatgttcggtattgtcatggcatttcaagattataatccgggccagggtattttgcattctaagtttgtcgggcttgaaaattttaagtacatgtttcaaatgaacgatgtcaaacaggtactgtgtaataccgttgtaatcgcggtaggaaagattattgggaatattattttcccattgatttttgcacttctgcttaatgaattctgtattaagcggctcaagcgtccaatccagacaattgtttacctaccgtattttctgtcgtgggttattctggcaaagattgttttaaatatctttggatatactggtccaattaatcagctgatggaggcatttggtagaaatccgatcaattttttcggggagccatcattgttccagcctctggtgatcggcacagatatctggaaaggatttgggtacaatacggtagtttatctggcagcaatacttggggtagaccagagcctttatgaagcagcagcggcagacggagcaggaagattcaaacgtatctggcacataacgctcccgggaataaggacaacggtagcccttctggcaattctgtcacttggaaatgtgctcaatgcaggttttgatcagatctacaatttgtataatccgcttgtttattccactggtgatatcatagacacatgggtataccgtgcaggacttgagaacctgcagtactcgctggctacagcagttggactgtttaaatcggtgatcagcgttatcttaattgttataggatataagctggcagataagtttaccggttacaaactattctaaggaggtgcagtaaatgatagaaaataaaagtataggatcaaaagtattcgacgtagtaaatgttgtgatccttattttgatcacactggtctgcatcctgccggtatggtatgtcctttgcgtttccttaagtagcagggaggctgtcagtgcagggaaagttgctctctggccggtgggatttaatctcctgtcatataagaagatcttgggagagggaaatttctttacttcttttcttgtgtctattaaacgagttgtgttaggtacaggggccagcatggtgtgtatacttttggcagcatatccgttgtcaagaacaaaaaaacagtttccgaagaggggcatcttcatgtggatctttgtattctgcatgcttttcaatggaggtactgttccgtggtatatcacaatgaagaattacggtctcatggacagcatatggggacttgtcttcggtatggggcttcaggttttcaacgtcattctggcagtaaactttttcaagaatctgccagttgaactggaagaggcatgctttatagacggtggtggaccatggaggaatctgatctcaatttacattcctttggcaaaaccgatggtggcaacgatctcgctttttacgattgttcagtactggaacgagttctttcagggaatggttctaagtacaaaacaaagcagctatccgcttcagacatacatacagcagatggtagtaacattggattattccagtatgaatgttgaacagatcgcacaggcaatgaaactaaataaccagtcgctggacgcagcgaagatatttatcgccatgatcccggtgctgatcatatacccgtttttgcagaaatattttgtatctgggatcacgttgggatcggtaaaaggatagtatccggtcagaaagagtctggcgaaaatagagaatagtaaaaacgaaaaggagaaaatggattatgaaactaaaaagaataattgctatagcgtgtacggcagctatgacggtatccttgatttcaggctgtggtggtgcatcagacaaagggcagaaagaagcggtcaaggaagcagaaggaacagcgaaagaagatctgcctctggcaaaatacccggagacggttacggtacatctgggcggaaaaatgaatccgaatgcaaagattccgaaaggaatgtcatttgaagacaactcctatacaaggcttctgaaagagaacctgaacatccaggtagtatatgactggactgcatctacatcagactatgatgaaaaaatgagtctctgtatcggaagtaataccattccggaaatcatgaatgtaaatgcaacccagtacagggctctgttgaaatacgatatgatacagccactggataagtattttgatgattatgcttcagatgcactgaaaagttatgtgaaatccggcggtgaagaactgcagaaatgtatcaccaatgaagatggagaactgatggcgattcctgccccgaacctgacagcaggcggtgtaaacgaaatgtggattcgtcaggactggctggatgctcttgggctggatgtaccacgcacatgggatgaactggcagaagtggctaaagcatttgtgacaagggatccagatggaaatggagagaatgacactatcggtattcttggaccaggaaattcggaccacatgaatgcagtaggcggcaaccagtttggacttgacccattgttcagctgttttcagtcatatccgcagtactggctgaagagtgaggacggatcggtagagtatggttcgattcagccggagacgaagactgcactggaaaatatctccaaactttatgcggatggtgttattgatccggagacacttgtcagaagtgatagcaaggagccacttcttgctggaaaagtaggaatctttttcggaccgtggtggtgtgcatatacatttgcggatacaactctgtcaggttcagcagactggcgggcatatttcacacctctttctgaggatggaaaatattatacgcatatggctgagccaacgacacagtatgtcgtagcgagcaaggactgcaaaaatccggaagctgcgtttaagatcattaactacatagttgcaaatgagcagaaatgggtagaagagggcgtaacatctacggagatgggaaccggagatttctatcctttgtataatacgtatgacaatgctgatgagatagagaaatcttatgaagcgctgacgaaatatcttgcaggagatatcagtatggatgatgtagatttttcgacacataaactgctgaagaacgatatggaagcagttacgaaacttaagaaaaagccttacgatgatttcagtcttaaatattggaatctggatagtgatctggcaaaaacaaatctgcctcgtctggttgcaatcatggtaggtgacgcgccacttgtaaatgaggaatatgttccggtttacaacgcttacaacggacagacggaaacaatggaagcgaaatgggcaaatctgaagaagatggaggaagagactttcgcaaagatcattatgggaaaagcagatatcagcgaattcgatactttcgttaaaaactggaagaatcagggtggtgatcagattctcaaagaaatcaacgatgaattaagtaagtaaaagagacggcggctgatggtgttcattagccgctgttccttaattggaggtataaaatgcgggaaaacaaagtaatctacggactgataggatatggtggaatgggcagatggcatacagaaatcctgtcaaatgtaccggaaattgaaattggtggtatctatgatatcaaggaagaaaagagaatagaagcaaaagaaaaaggtttttctgtgtatggttcggaagaggaaatgttatcagacccggatattgatgtcgtgctgattgccactccaaatgactgccataagccgattgcaatccgtgctatgcatgcggggaaaaacgtgatatcagagaaaccggtgactctgtcatcttctgatcttcaggagatggaaaatgttgccaaagaaaccggaaagttcctgacagtacaccagaacaggcgctgggatgatgatttcctgatcatacgaaagcttgtagaggagcagaagctggggcatgtcttccggatagaaagccgtgtgcatggttcaaggggtattccgggtgactggagaaaagaaaaaatacatggtggcggaatggttcttgactggggtgtacatttgctggatcagattctgtatctttacggagatagaaaaattgaaactgtatatgcatcacttacccatattaccaatcaggaagtggatgatgggttcaccacaatcctgacatttgaaggcggaacggaagtcttagttgaagtaggtaccaataattatatttccctgccaagatggtatgtactgggtgaagatggtactgcggtaatcagggactggcagttaaatggtgagatcatacggaaaacaggcataaccgaagagaaagtagtgccggtaaagacagcagcaggtctgaccaaaaccatggctccgagacgggaagatacaatcgtgaaagaagagctgccacatgtgtccggagatattgcggatttccataggaatgtagcagcagttataagagatggggcagagccggagattaagctcttccaggtgatgcgcgtaatgaaactaatggaagctattttccaatcagcagaaacaaaccaggtgattgattatagacagtatgaatcataagtatttatgaaggaacaggagaaaataagtatgaaacagataaaaataggaacatgcgttcctggaactaaggcagaagaatggttaaagggatttattggaaaaggatttgagacattttctcttaatttccatatgtcactggaagggactgaccttgataagctggcattgagcacggaaaaactgttggcaggtacggattccgaaatcacgacagttggatactattgcaatcctatccagtatgcagagcataggaaaactctggaaaatgtaatctgcactgccggaaaattcggagctacacatgtgagtacttttgcaggagcgtgggaaggaaagccggtagaatccgcatatgaagagtttggcaaggtattccgggaactggctgatcttgcagaagaaaagggagtgaagctgggaattgagaattgccttatggatggaacatgggaacatgcgacatgtaatatcggttttaaccctaaagcgtgggaagtgatgtttgaggaagtaaagaatgataacttcggactggaatgggagccgacacatcagatggtacagcttatcgatccggtaacagagctgagaaaatggtgcaaaaaaatagtacatatacatggaaaagatgcaacaatagactgggatgctgtaagacatagtggcatatcaggcgcagtcccatttgtatggcatcgtatgccgggctttggtgacacgaactggagagatatcatttctattttaagaagtaacggatatgaggacgatatctgcattgagggataccatgatcctgtatattccggagaactggagatgaccggacagcttcatgcactgaattatctgaaatggtgcaggggtggagattttacacaaactccatgggaaaaatagggaaaacagatacaggaggattttctatgaaacttgggtttattacatcaatccttgacggatggacttatgaacaaatgatggattttgcttcagagcagggatttgaatgtgtggaagtggcatgctggccagaagaaaaagcagaaagaagatatgcgggtgtaagccatatagatgcagaacgggtaaaccaggatgatgaatatgcagcccatattatggcatatgcagaaaaagcgggagtagaaatctctgcactggcatattatcctaacgtaatgacggcagataaagagaaaagaaatgctgctattgaacatctgaagaatgtcatacgtgcaagtaaaaagttaggtgttggcatggtcacaacatttatcggaagggatcagaccaaaaatgtacgggaaaatcttgaacttgtaaaagaaatatggccaccaatcataaaactggcagagatatgtgacgtaaaaatagcaattgaaaactgcccgatgctttttggtgaggaacagtggcccggaggacagaatctgatgacaactccgccaatctggagagaggtctttaagatcctagacagtgataatcttggcattaattacgatccatcccactttatctggcagatgatcgactatatccgcccgctttatgaatttaaggataaaatattccatgttcattacaaggatatcaagatatacagggataaattagagtcctgtggcatcatggcttatccgctggaatatatgtcacctaagattccgggacttggcgatgtggactggggaaaatacgtgtcagcacttactgatataggatatgatggctgtacatgtattgaaatagaagataaagcatttgaggattccaaggaaaaggtggagaagtctttaattctcagtaaaagatatctggagaaatatgttatataacacagaaaagtgcaaataaggaggaaataccatgagaaaattaagagcaggaatcgtaggctgtggagggattgctaacggaaaacatctcccagctatgcagaaaagtggtctctatgaggtggtggctttttgtgacatcatcatagagcgtgcgcaggagacaaaagaaaaatttggcacagaagatgcaaaagtatttgaagattaccgtgaacttctaaaagaagatctggatgttgtatatgtaactaccccaaaccgttcccatgcagaaatctctatagcagcaatggaggcaggaagagatgtcatgtgtgagaagccaatggcaaaaaattatgcagaagcacagaagatggtcgaaactgctgaaagaacacacagagttctcaacatagcatatcagaaccgttatcgtacagattcattgtatctgaaggaaatgtgcaaaagtgatgaattgggagaaatctattttgccaaagcacatgcactcagaagaagagctgttccgacctggggtgtgttcctgaatgaagaagaacagggcggcggtcctctgattgatattggtacacatgcactggatctgacattatggatgatggataattatgaagtgcagtctgttacgggagcttccttccacaagctgtctgatcagacagaccagggaaatgcatttggtaactgggatccggataagttctgtgtagaagattctgcttttggctttatccgtatgaaaaatggggcagtgatcgaactggaatcagcctgggcactgaacacactggaggttgatgaggcaaaaacaagcctgtgtggtaccaaagccggagctgatatgaaagatggccttaggatcaattacatccaccataatgcacaggtagtagagaaaccggaattatcaaacggtggagtagcatttttctcaggaaaagaaaagtcagcagcagactatgaacaggaattgttttaccacatcgttgttgatggggcagaacaggttgtgaagcctgcacaggctgcagttgtcacacgtattctggaagcggtgtaccgttcagcagagagtggagaaaccatttattttgattgagggaaaagaagattatggaacaaagaaaattaaaaaagttgttgtctgagatgtcattgcgtgaaaagattgggcagatgatacagctgactggaatttactttgatgatgatgcggtacttaccggggaggtgggggaagaccagccacctcagtgggtgactcagtatgctggttctgtactaggtatgatcggggcagaaaagctcaggggaattcagaaaaaatatgtggaagcgcatccgcatcatattccattgctgtttatggcagatgtcatacatgggtgcaggaccatagctccgattcctttgggacaggcttgttcgtttcatccggaactggttagaaagatggcgggacatgccgcagcagagtctgcttctgaggggatcagggctacgttttctccaatgattgatgtatccagagacccgaggtgggggcggataatggagtctttcggagaggatccttttctgaacggagttatgggaaccgcaatgcttagaggatatcagggcgaagaaggaaaagacccggcagggaacaaaaaaataccggagtccggtatcgcaggctgtttaaagcattttgcaggttatggtgcagtgaatgcgggaagagaatacaatgatgtggaaatatcacagagaaccttccgggaacagtatctcaaaccattccgtatggcaatgcatgcagatccggcaatggtgatgacagcgtttaatgcagttgaccgcagaccggtcagtggaaacaaggaactgcttgaaggcactctcagggaagaaatgggtttcagtggcactgtgatttcagattggggatccatagggcagttggaggaacagaatgtagtgtcaagccagaaagaggccgcagaggccgcagtccgtgcgggagttgacattgacatgatgagtccggcatatatgttccatctggaagaactggttaaagaagggagtattccaacttcgttgatagacaaaagtgcatggaatgtgctggtgatgaagaatcggcttggcttgtttgaaaatccatttgcaggaatgcagggagaagaaccgttgtctgctgaggcaaagaaaaccgcgcttgcgctggcatgtgagagttcggttcttctgaaaaatgatgatatgcttcctctgaaaccggagaggaaggtattttggggcggaccttatgtggagtcaagggaattgctgagcagatgggcaattttcggccgttatgatgatgtggaaacgataagagaagtcctgaaagcccggaagatgccggttcgttttctgccagaatgtgagattctgacagaagaggaaaggaggctgtggcaggctgaaaactgtagaattcaggacagcggagaacaggataaagagatacctgaaatatgcgtgaatagtggaaaacaatatgccacactggatgaaattgaaccggaggataccgtggtacttgtacttggagaacatgaggcacagtcaggtgaagccgcgagcagggcatttcttgatctgccggaagggcagcagaagttttttgatgcagtagctggccgtacctcccatattgtgacggtcattctatcgggcaggccgttggatatacggaaaatagcggagaaatcccaggctgtcctttttgtctggagaccgggaacaatgggagctgaggctgttgttcgcttggtgtatggagaagagaccccatcaggaaaactgtctgtgagcataccatggtgtgtgggacaggtgcctgtcagttactgggatgtaaagaccggacaccggatggtagaaacgaatccggagaatcgctttacgagccggtatatggatattccgaatgaaccgctttatccatttggattcggtctctcttacacagagttcaccattaccccccccatatttgagaaacaggaaagagaggataagattgacatatcctgcaaggtgaagaatgtgggagaagtgcctggggcagaagtcgtgcagtgttatgtggagacactttgtgctcctgttgtgcgaccggatagagaacttatccggtttcggaaaatttttctgttgccgggtgaagagcaggaagtaaaatttacggttaatcggaaggaactagctttttatggagagaatatggaactcatagatggagatgtccagtttcgttttattgttggaaacagtagtaggtcagaagcggggagtatcctttatgctttttgagttgacatttgatgaatgattctccgggcattttgagaatctcaaatgtcaggaagaacataatttaaagcaggggacattgtgatggaaagaatcacaatgtcccctgaaagtttttcgggatatacaaatccctacccaaaaaatatgaagaaagtattatgggcagaaaacatcaatggacaggaaccatttgtaaaatcatggatagaatatcagaaggaatataagtgcaaagacagaatgtttgtggtatgctagagacaggaatctggtcgtaacggtttgttggtaaaatggtggatggttacgaatgacattacggaggtgtcaggcatgggaagttatctgaatccgggctgcaaaggctttgaggagagcttaaattccgcaatttatgtagataaaactgggttaatcgaaaaagttaatgcggttgttgacacacggcagaaatatatttgtgtcagccgtccgcggcgatttggaaaatctatggcgacggatatgctggcagcatattacgatcagagcgtcgatacggcgcggttgtttgatactctgcagattgcaaaggcagagacttatcagaaataccggaatcaatatgatgtgctgaaagtgaatatgcaggaatttttaagcatgacgcacagtatggatgaaatgcttgcggtttttcaaaaacgcatgattgcagatctgaaaagaggatatcctgattatgtcatggatggagaagacagtctggtgtttgcgatgaaagacgtatatgcacatacgaagtgcccgtttatcatactgatcgacgaatgggactgtctgttccgcgagtacaagcaggataaagaggcgcaaaaaaaatatctggattttctgcgggtatggatgaaagatcaggaatatgtggcacttgcctacatgaccggaattttaccgataaaaaaatacggttcgcattcggcactcaacatgtttacggaatattccatgaccaatccacgcgagatggcggagtttttcggttttaccgaagaggaagtgcacgcattgtgcgcaacatacaagcgcaattttgaagaagcgcaggcgtggtatgatggctatgaacttgtcgcaatggacggagaaaaccccaaaatctattccatgtacagcccgaaatcagtggtcgatgcaatgttaagcggtctgtatgataattactggaatcagaccgaaacatatgaggcattaaaaatttatatccagatgaattttgacgggttaaaagatgccattgtgcggatgcttgccggggatcgtgtggaaatcaatacagggacattttccaatgatatgacaacattccagaaccgggatgatgttctgacactcctggttcatctgggttatctgagttatcactggatggacaaaacggtgtcgattccaaacaaagaagtgtcacaggaatatgtaaatgcaatcagtaccatggactggcatgaggtgattgattctgtcgaagcgtcgaaaaatctgctggaagcgttatggatgcaggacgaagaggcagtggcagcaggcattgataaagcgcatcgtgagatttccattttgcagtacaacaatgaaaattcgctggcatgtacgatcaatctggcgttttattttgcacgggaatactacacgatcataagggaatttccgacaggaaaagggttcgcggatctgtgttttattccaagaaaaatgcatgcagacaaaccggcggttgtgattgaactgaaatgggaaaaatccgcacagggagccattgcgcagatcaaagaccggcactatacagatgccttaaaggagtatcggggaaatctgctccttgccggaatcaactacaacagagagacaaaaacacatacgtgtgtgattgagcaattaacaaaagaagactgacaggaggaaaccaaaatgagcaacgtattagaagaaatgaaaaccagaagaagcatccgaaaattcaaaccagatgccatcccacaggaaattttagacaagatcattgaagcgggaacctatgcggcaaacggcagaggcgcacagaatgtcatcatcattcaggtgacaaacaaagagaagcgcgatgaaatcgcaaagaaaaatgcagaaatcatgggaagtgagggtgatccgttttacggcgcaccggcaatgctcatcgttttaggaaaaaaagactggccgacacatgtttatgatggaagtcttgtgatgggaaacctgatgcttgcagcccatgatctgggaatcggcagctgctggattcaccgcgcgaaagaggaatttgaaagcagctggggcagggaactgcttgcatcccttgggattgaggataaatatgagggaatcggacactgtgcgctcggctatgtggacggggattatccggatgttattccaagaaaagaaaaccgcgtcttctatttgaaataaagataaaaatttgggaaataggtgttgtaactgcacctgttttccagccacttccgaaagtggaaaatttacaattgtaaatatgagttgacgagaacagatagatacgttattctatatttacaaaactcacaccaatcaaattcagtcaaaaacaggctggacaaatcgtttaaagcacaagaagttcaggtgcttacaataccacgagttttaacaattaaatatgggatggcatttgggaaaatggcttgtttctgcggatgaatgattgcttaattaatagtgtatgttatactataaaaaagactttcataacaatatcgatgctcccagtgtcttctctattcacaaaaggaagaaggagaagaatgatatggcaaatgcaaaaaagtatgatgacttaacgtttacagatgattttatgttctgtaaagtaatgacaacgaacccggaactctgtcacgagttgttagaacttattcttggaaagaaagtaggtgctttcacccgacttgatcaacagaaaccaatagaaatgacggctgatggaaagggcatacgatttgatgtgtacagcgaggatgattccgggattgtgtatgattgtgaaatgcagacgagcaaaaaagataatcttccgaagcgtacgagatattatcagggaatgatagatttaaatttacttgaaaggggtgcggattataaagaactgaaaaagagctatgtgatctttatttgtccatttgatcaatttcaggaggggttacacaagtacacatttgaaaatcaatgtaaagagataccagaacttgtattgggagatgagtcaacgaaaatattcttgtgtgccggtgggcatgcagatgatgtatcggatgaaatgaaggactttttaaactggcttacgacaggacagacaggcaatagccaattcgtgaataagcttgaaaatgctgttctgaaggcaaaaaaacatgaggaatggaaggtggaatacatgacgttacttatgagagacaatgaaatgatggaaaagggccgtaatgatatgcttttttcattggtgcaggacggaacactgtctcttgagattgcagcaacaaaggcagagatgccggtggagaagttcgcaaaagccatgaaagaagcaggatattttataagggagcttccatgagagaagattatcatatttattatgaaaatgaagaagaactgtccgtctggcaaccggaaataaaaatgtaatggcaaatagaaagaaaaggagacaaaaaatatgccttgtacaacgatattagtaggaaaaaatgcaacctatgatggttcaaccatgattgcgagaaatgatgatgcgggtggaaacgatcactttacgccaaagaaaatgatcgtggtgcagccaaaggagcagccgcgtgtatacaaagcggtactttcttctgtagaaattccgcttccagaaaatccgcttcgctatacggctatgccaaatgcagtggaagggaaaggaatctggggtgcatgcggagtcaatgaagcacggactggaatgacggcaaccgagacgatcacatccaatccacgcgcactcggtgcagatccgctggtggaaaatggcattggagaggaagatattgtatcgttagtacttccttatatccacaatgcaagagagggtgttcagcgattgggagaacttctggaaacctatggcacttatgaaatgaatggaattgccttttccgatcagaatgaaatctggtggatggagaccattggcggacatcactggattgcacgccgtgtgccggatgatgcgtatgtggttatgccaaatcagcttggaattgatgcatttgatctggatgatgcatttaccatgcaggaaaatcatatgtgttctgcagatatgcgggagtttattgcgaaccatcacctgaatctatccatggatggcactctgaatccgcgcgaagcttttggcagccatgacgatgcagatcatgtgtacaatacaccgcgtgcgtggtatatgctgcgttgcctgaatccacacacatacaactgggatggaccggatgcggattttacaccggagtccgatgatctgccatggacactggtaccggagcgcaggattacggtggaagatgtgaaatatgtgctttcctcgcattatcagggaacgccttacgatccatatggagcgtatggagatccggggcagcgcggcatgtatcgttccatcggtatcaaccgcaatgattttgttggtctggtacatatccgcccggagcatggagaggatgccaatgtactggaatgggttgcgtatggttccaatgcctttaatgccatggtgccgttttatgcacaggtggagaaaactcccgaatatgtggccaatacgacagcagaagtttctacggataatttttactgggtaagccggatgattggtgcgatggcagatgcctcttataagaaatcggtgttccatgtcgagcggtatcaggagaaagtgctgtctaaaggacatgagattatcaatcattatgataagctgctggaaaaagaaaccaacgcaggaaagcgcatggcacttaagacagaagcaaacaatgcggtggcagatatggtaaaaaaagaagctgccgatacacttgataaagttctgtttgaactgtgtggacagatgaagaatgcatttgcccgttccgatgcttaacgcatcagtttccgccgcagaagcagatacgccgtgatcataaccgtaccggtcagtacccaggagatcggatagataatcataacaacccagaattcatgtacggcacggcagacggtgttgatccagataaggcgcagcacacaggagccgaccacggtgatcagagccggtgtcagggaatgaccaaagccacgcatggcaccgccgctgatctcgtaagtggaggtcagaagttccagtgtggtgacgatcagaaggcgctgtacggcaaaagtcaggacattcggatcggtcgtgtacaggcgaaggaaaaagtcccggccaagtacaataataccggataacagaccacagaatatcacggaaaaaatcatgcagagacggtatacttttttgcaccgctgaaaatctccggcaccgtaattctggctcgtaaaagttacggtagtctgggcaaatgcgtttaccataaaatacgcaaaaaattcaaagttcagtgcagctgcagatcctgcgatagcgtttgatccaaaactgttaatcatgctctggatgcagacgttggcaagggaaaagaccatgccctgcagaccggcaggaacgccaatgatcaggatttttttcagttcgccccagtcaatggacaagccagagaggctgacacggattggttcctgttcatgcagtaaaatataaaacagaataccggaacttacaatattagaaacaacggtggcaattgcgacaccggatactcccagatgaaatacaatgacaagaatcaggttcagtccggtattaatgattccggcggcaatcagggcatacagcgggcggcggctgtcaccgatgctgcgcaggattgaggaactgaaatcataaagcatgataaatggcatgccgagaaaatagatccgcagatataaaactgccagatcgagaacatcttttggcgttcccatcagtgtcagtaccggtctggcaatgaactgccccagtacaagcacgaaaatgccgctgcataaagcgacaacgatggcggtgtgaattgccgcttttatatgttcttcggctttctgtccgatgtagcgggaaataattacgttggaaccgagcgaaattccgatgaacagattaatcatcagtgcgatgagcgaactgttgcttcccacggcagccaatgcacggctgcttgcaaaacggccgaccactgcggtatccacagaattaaataattgctgtaaaatgctgctggcagccagaggcagggcaaaaagcagtaatttattccatagagatccatgtgtcatatcaattgtatttttcttttgcatattcatagtgaaacaaatcccttctttaataagtacagatgattataatcccgggaaatcagaaaatcaatagctacagagttttgagaatatttgtaataaactaaaaaatgtgttgacattttgcaagaagagtgctagttttttgttaacaaagagaaatcaggcaaatgcatcgaacagaatacgatcacaatatacttttttccagagagttgtcgggcggtgcgagacaacagacagatatggtgaccatcctctgtgagctgtgggctgaattccgtcaggacagtaagcttcaccggtattctaccgttatcaggaaccttatttctgcagaggggagtctgttgagatgagagtgagtggtcgttttatacggcaaataaagtggtaacgcggaagcataacataagccttcgtctttatatactgataagaggtatatagggacggaggttttttattcctgttccattctctttgcaaatatttaagaagggagtcgccaaatggcgaaaaaacaatgaatggtttagttatcgtattaattgcaattgtagtacttggtgccggctatctgttatacggacgctggcttgccagcaaatgggggctggatccgaaagcaaaaactccggcttatacgcatgaagatggacaggattatgttccttcctccaaactgacagtgtttgcccatcagttttcttccattgcaggtgcgggacctgtcaccggaccgatcctggcatccgtattcggctgggtgccggtattgttatggctgctgatcggaggtctgtttttcggagccgtgcaggatttcggtgcactgtatgcttccgttaaaaatgaaggaaaatcgatgggaatgatcatcgagaaatacatcggaagaaccggacggaaattatttatgctgttctgctggttgtttacccttctggttatggcagcttttaccgatatggttgccggaacgtttgtcggaaaaggtgtggaagggatgacaaaggcaacaggctatgcgaattccgcagcagcatccatttccatgttgtttatcgttgttgccatcatctttggcctgattcagaaaaaggtcgggaaaatgaaagagtgggttcgcgcagtggttgccattgccctgttggttgtcatgtttatcattggtatgaaacttccaatgtatgcgacaaagagtacctggatctatattgttatggcatatctgttccttgcctctgtcatgccgatgtggctgcttatggagccgcgtgattacatgaccactttcatgctgctgggcatgattattggtgcggttgtcggtgttattgccgagcatccgactatgaagctgaatgcatttagcggatttaatgtagatggcagttatctgttccctaccttatttgtaacgattgcctgtggtgcggtatccggattccacagtctggtttcttccggaacatcatcaaagaccatcagtaatgagaaagatatgccgatggtcggttatggtgccatggtggtagagtcactgctcggagtcattgcactggttgttgttggtgcggttgccgtaaacggaacaaagccggagggtactccgttttctattttctctgctggtgttgcaggatttttcgaaaaattcggtattccggtacaggttgctaccgtatttatgaccatgtgtgtatctgcactggcactgacttctctggattccgttgcgcgaattggccgtatgtctttccaggaactgttttacggagataccaccgatacttccaagatgccgggctggcagaaagttctgaccaataaatattttgcaacaattattaccttattctttggttatttactgactcttggcggatacaataatatctggccactgtttggttctgcgaaccagctgcttgcagcacttgtactgattgcacttgcagtattcttaaagacaaccggaagaaccggctggacactttacataccgatgtttgttatgctggcagttacgtttaccgcactgatccagaagaccattgcactggtttccaatattgccggtggtcaggcaaccttcctggtagacggtctgcagtttatcgtggctattcttctgatggttctcggtgtgctggttgcattcagctgtctgaagaaactgttcactgcaaagaagcaggaagcataaactatttgttctgttttctccattcccgaggggaaacaccataaatatttttaaatgcacgggaaaaatgaagctgattttcgtatccgacggcagagccgatatctgcgatggacagggaagtcagctttaataattccgttgcctttaccatgcggtagttcataagaaattcctgtggggagcgaccggtcgagttgcggaagatttttccgaaataactccggttgatgccacataccgcagcgatatcttcaatcgaaatagtattctgaaagttctgttccatataattgatcgcttcttttatataataatcactcatgcgcccgctggagatcagcgttgtcgactttgccgactgcagcagataatccaaaaacagatacagatgcccgatcagatggaaggaggattcctgcggatgattgacgatataaagcatttcatcggcaagttttttccgtaattctttggaatgggaatgataaacgggcgcgtctttgcacaaatctgtgacacttaaagcctcttttacacgtaagccgtcaaattcgatccacatatattcccatggaagctgttcatcggcaatgtaagtattgatctgccccgggaaaatcataaacccctgtccgctttttacagaataggtccgtgtttctcctttggaattgtctgccatgagtgttccggttccggaaagaatgtagtgaaacaggtagtggttgcgtgttgcaggtccgaaagaatgaccgggatcacactgttcgtatccaaactgatacatgcacagatcaataaaattttcatttggaaaaatattaaaaaatgtattactcataaaacactccgtatataccaaaatgcgatattagtatctattatagcacaaaatattgcatttaggtataaaattaaaaaaatatgggtatttaaggacgcataaaggtatgttataatcagattatcaaaaaggcaagcggatatatttaagaaaaggagagaggaatatggcaaaaaggaatattttccgtggtcttgcggctgtgcttgcacttggtatgtgtatgacaggacttgctggatgcggaagcgaaaaaagggcggatggaaaaacggagattgaagtggtttcctacaaaccagaagcagttaaggcatttgaaaaaattgaaaagcggttcaatgaaacacatgatgacattcatttgacgatttcatctccaaatgaagcaatgaccattttaaagacacgttttatccgggaggattatccggatatcatcgcaatcggaggagacatcaactattccaactttttagatgcagatctgtttgaagatatttccggtctggatgaagtccagaccgtaaaacaggcatatctggatatggataaggaactagagtttattccaaaggatggcacgtatgcacttccatatgtggcaaacgcggcaggaattttatataacaaagatctgtttgaggaaaatggctggaaagttccgaccacctggcaggaatttaccacactgtgtgatgaaataaaacagagcggaacacttccgctgtatctgggatttaaagatacctggacctgtctggctccgtggaatgcgctggcagtcggacttaccgattcggacacctgcaatcaggtaaatatgggaaataccacatttgccaggacttatgaaccggtagcagaaaagatgcgtgcgcttttggattacgcagaaaaaaatccgtatgcatatggttataacgatgcctgtacagcatttgcccgtggggaatctgccatgtatccgatcggaagctatgcgattccacagattaaatcggtcaatccagatatgaatatcggctcttttacatttcctgcaaatgatgaggaatcagacaatgtattaaattcaggaattgatttacagttttctgtgatgaaagcatgcaaaaacaaagaagcagcatatgaagttttaaaatatctgtatgacgatgagaccattcagatttatctggatgatcagggcggaatcgcctgcaaggatggggattttgcaattccggaaacacttaaggatatgcgtccttacattgaaaataaccgcatggcagattatcaggatcaccattatccgagtgagatgagtgtggatgccatgatccagacgttcctgctggatacaagcgataatgcacaggaaaagtttttgaaaaaatttgattccggctggaaacgctacaaccgggatctgattcggaaagtacaggattatcagaaagaacaggaggatgcacaatgaaaaagaaaatgtcaaacagggacaaaacattctgggcggttgtcataccggttgtaatcttattttttgcattcaatacacttccaatgatcaaaggtgtgatttacagctttaccaattataaaggatatggaacttacgattatgtcggattccggaactatgcagatctgtttacggattcccgcgtgggaaaaagctatttgtttacgtttaaatatgcactggcaggaacgatactggtaaatgtgctgagtctgatcatggcagttggattaaacagtgcaatccgttttaaaagtgcactgcgcggtatttattttgtaccgaatattttaggaggacttgtcatcggctatatttttagttttatttttacttacattcttccaactgtgggaaatgtgttccatattggatttttgcagaacagtattcttgcaagtgaaaaatacgcatggattggtgtgctgattgttggtgtatggcaggcagttgccatgaataccattatttatatttccggtctgcagaccgtcccggaggaagtttacgaggcgagtatgcttgatggagcaagtaaatggaaacagttctggaaagtaacatttccactggttatgccgtttgtaacaatcaatctggtattgagcacaaagaattttctcatggtattcgaccagatcatgtctttgaccaagggaggtccggcacagagcaccgaatcgatctcttacctgatttataaaaatggtatggatggcggacagtttggattccagagtgcaaatgcagttattttctttattgtgattgtggcaatttcacttttccagatgacagtcatgaataagaaggaggagcagttatgatgaaagaaaaacagaaaacaaaccgggtacttacgattgttctgattttggggacggttaccgtattttttccactgtatatggcagcgatcattgcgtttaagaaaccaagtgagatgacaaacgatgtggcgggtgcactttctttcccgaaacaatggagttttgaaaacttccgtcaggcaatggaagtgaccgatttctggcgttctcttggaaacagtttactgatcactctggtaacgatcgtactggcaattctgatccactcgattgcaggctatgtgatcgggcggggcatggcaagaagaaaaagtttccgttttatctatctgtatattgtcagtggtatgtttgttccattttccatcttaatgatgcctctggtaaaacagacggcacacatgggacttggaaaccgcgcgggtgtcattctgttgtatctggtattttacatgccaatgaatgtcctgctttacagtggatatttaaaaaatattccggaagcactcgaagaagcagcagatattgatggggcaagtacctggacgacttactggagagtggtattcccgatgatgaaaccgatgcatgcgacggttgcgattctgacagcccttggaacatggaacgatgttatgacaccgcttgtgatcatgtccggaaccggacagaatacgctgccgcttgcacagcttaacttccagacacagtttggaaccaattacaatctggcgtttgcctcctatattctggcactgatcccgatcctgatcttttatatgatctgtcagaaacagattttgaatggtgtggcaaacggtgcagtcaaaggataaaaaataaaacgaggtggcttctatggcaattatatacaatccaaataaaaaaatatttaccctgcatacggcgcatacaacttatcagatgcaggttgatccactgggatatctgctgcatctgtactacggagaaaaaacaaacagttccatggactatgtcctaacctatgcagaccgtggattttccggaaatccttatgcagcgggcatggaccgcacctattcgctggatgcgctgccacaggaatatccgtcccttggcaccggagattaccgcaatattgcactgaatatcaaaaacgaaaaaggggtggaaagtgcagatctgctttttaagagctatgagatccgaagcggcaagtatcagttacagggacttccggctgtctgggcagatgaaaacgaagcacagacactggaaatagtccttgcagatgaaaacgcacaggttgaagtgcatctgctgtatggcgttttagaagaaaccgatgtcattacaaggagtgtacggattaaaaatacgggaaccggacagattacgatcgaaaaggcagcggcagcctgtctggattttgtacagggagattttgatgtcctgcggttttatggaaagcatgccatggagcgcaatctggagcgcaccccgctgggacatgggacgattgcgtttggcagccgcaggggaacatccagccatcagtataatccggcagtaattctggcagaaaaagggacaacagagacggcaggcagctgctatggcatgctgtttgtatacagcggcaatttctcatgtgaggcggaaaaagaccagttcaaccagacgcgcctgcttcttggattaaatgaagaactgttttcctacccgctcacggctggagaaacctttacggtgccggaagtcattttatcctattcggcagatggattgtctgctttgtcgcagcagtatcataactgcatccgcaaccatgtgtgccgcagcaaatatgtccatatgcagcgtccggtgctgatcaacagctgggaggcagcctatttcgattttacgggagatacgattgtggatctggcaaaagaagccgcttcccttggaattgatatggtagtgatggatgacggttggttcgggaaaagaaatgatgacaattcttcccttggggactggcaggtcaacgaaaagaaactggggggcagtctggcagatcttattacccgtgtgcatgagcagggcgtgaaatttggcatctggattgagccggagatggtcaatgaagacagtgatctgtaccgggcgcatccggactgggcgatccggattccggggaaaaagccggtgcgctcgagaaaccagctactgcttgatttttccagaaaagaagtgcgcgactgtgtatttgaccagatctgtgccgtgctcgatcagggaaaaattgattatgtcaagtgggatatgaaccgcagcatggcagatgtttatgccggaaatctttcctatgattatgtgcttggggtctatgattttctggaacacctgtgcagccgctatccggatcttctgctggagggatgcagcggtggcggcggcaggtttgacgcgggaatgctttattattccccacagatctggtgcagcgacaataccgatgcgatcaaccgcacaagaatccagtacggaacttcgtttttctatccggtttccgcgatgggggcgcatgtttcggcggtgccaaatcaccagaccggacgggtgacaagtttccatacccgtggggtgacggcgatggcgggaactttcggttacgaattaaacccggcgcttttatcggatgaggaaaaacagcagatccgggagcagatcaaaacgtacaagaagtatgaaacgctcattaacgagggaacgtactggcggctgtcggatccgtttacggatgaaattgcggcatggatgtccgtctcagagcaacaggatcatgcactggtaagcgtagtgcgtcttatggcagaggcaaatcaggcgaccgtttatgtccgcctgcgtgggttaaaaccggatgccgtgtatctggaagaacagagcggcaggcagtattccggtgcagcactgatgcatgcgggaattccgcttccgccgtttaccagagaatatgaggcatatcagtttgcttttacagaactgaaagaggctggaacattatatgaaaaagtgcagaaatggcgtgacgggaatgtcaaaaatcgagtggtcatcagcctttacggtggctccggttccggaaaaacaacacttgcaacggcattgcagcagtactttttaaatgacggaacgggttgttatctgctctctggcgatgattatccacaccggattccaaaacgcaacgatgaagaacggatgcgtgtgtataaagagacaggggaagacggactgcgtggatatctcggaacaaagaaagagattgacttcgaccggatcaatgaagtgcttgcggcatttcatgagggaaaagatacgatcacattgcggcatatgggacgggaagatggcgagatttcatcggaagaaaccgatttttccggaatatccgtattacttctggagtggacacacggaggcagtgatgatttacatggtgtggatctgcccgtcttcctggaaagttccccggaggagacaaaggagcggcgcatccgcagaaaccgcgatgagaatgccgcaagcccgtttatctgccgcgtggtagaacttgaacaggaaaaacttgaagtgcagcgcaaaaatgcaggattaatcgtgggaaaggacggaagagtttatgaaccataaaccgatgctcaatgcatatcccgacagccttggaggaaatctgggagatattgtaacattgctaaaaactgaggcaatgcaggatgtattttcttccttttacattctgccgagtctgtatcattccgatctcgaccggggattttccgtgatcgactatgacctgaatgagcagcttgccaaccgggaagaccttgaccagttaaagaatatggggattgacctgaaactggattttattttaaaccatgcttccgcacagtccccacagtttcaggatcttgtggaaaaaggggaggcttctgcgtaccgcgattttttcatcgactggaaccgcttctgggaagggcatggaaccatgacggaggaaggctatatccagccggaggaaagctgcctgaagcagatgtttttccgcaaacccgggctgccgatcctgatggtggaatttccggatggaaaaaaggtgccgtactggaataccttttatcaggaagtgcatggcagacactatcttggacagatggatgtaaacatccagtcgccaaaggtgtgggagttttatcgtgaaacactggagaaaatagcttcttacggagcggcgatcgtgcggctggatgcctttgcctatgcgccgaagacaccgggaaagaaaaacttcctcaatgatccggagacatgggaacttttacagaagattcatgcgctggcagaacctttgggacttacgcttttgccggagatccacgcagcgtatgacgaaaaaatataccagacgcttgcagaaaaaggctatgcgacctacgactttttcctgccgggactggtcattgatgcgattgagaacaggcgcggaacataccttgcggcatgggcgaaggaaattgtggaaaagaagatctccacggtcaacatgcttggctgtcacgacggcatcccgcttctggatttaaagggactgcttccaaaagaggagatccagtcgttaattgaccggattgtatcccgcggaggcatggtcaaaaatttacatggacaaaagaatctgtattatcaggtaaatgccacgtactacagtgcattgggagagtcggatgaaaaaatgcttctggcgcgggccatccagatgtttatgccgggcaaaccgcagatctggtatctggatctgtttgccggaaaaaatgaccatgaagcggtgcagcgtgcaggggaatccggacataaggaaatcaaccggacaaatctttccggtgatcagatcgcggaaggactgaaaaaagatgtggttcaaaaacagcttgcgctaatccgtatgaggaatacccataaggcattttcggaaggtgcagaggtgacaatctccggagaggagagttctctggaaatccgctgggaatatgacggggcatatgccgaattgcatgtaaattttgaagaggggacttatacaatagaaagtaattgagaacagaacgatattacatgtaaaaaataacatgaaagcaagaaggagatgcaggaataccggtatctccttcttatgggtttaaatccataagctcattgccatgttcccgtaaccatttgcgggaaaccttatagtctggaagcacacgctccacctgtgcccagaagcgtggtgaatggttcatctccagccggtggcacagctcatggacaaccacgtaatccagcacttccggcggtgctttcatcagcaggcagttaaagttaagattgccctttgcactgcagcttccccagcgtgtacgctggtttcgtatggtgatcctgccataggtcacgccgacaaccggggcataaaaccgtacccgttccggaattacgcgcagtgcttcatctgcaagcacctgcaattccccgggagttaaaggtgcggctttcgggcgtgcagcttccaatttttgtttttgttccatttcccggagatgggcatacagccagtctgatttttcatcgacaaatttacggatctgccagtctgccatccagtaaggtgcccttaccagaaccgataaatccggacggatttccagtgcaacggtttttcttttgcttcggattattcgaatctgtgctttttccatttcatttccatttccaacaatatatgtaaaacagatgttttgtgttatgtcatcattgtaccatcattttattggaatgcaaaggggacaaaccaggggggaatttctgagtgtggaaaaagataaaatttgcatattttcgacagaaacattgcagtgggaggaaaaaaggcgtatgataaagcgagtattttaaagcggaataaagaaaggaacagagaaaatggaaggacgaaaaaatatggaagagttttaccgaaaactgaaggtaggaacgaagttgaagtatgcatttactacagtcattgtaacgcttgctattgctgtggttgtttcgcttgtttccattgtaaagatgaatgtggatacttataagttttacaaggaagcatatgcaaacagcacattgcagatggaaatccgtaaagatatacagcttgtgggaaaatatattttgtggtcgatgacaaccgatgatgcaagttccacacagagttattctaatttggcacagaagtatgcagatcaggttggaaaaaatgttaccgcactggagaagtcttataatgataaaaagaaagttgcggaattaaaagatgcgatagaagaactgaaaaaacagcgggcagcggtcgtggaactggcgaagcggaataaaaatgacgaagctctggcactgtttaattccgattataatgatgcaacagagaaaattcaggatatattggttgatatcggaaaagtggcatccgcagaggcaaagagtcagtatacatctgccagggtaacgggacttgtgagcattattctgatgattctcataggagcaggaacagtggctttctccactgtcatccggaccaccattaccggaattatgctaaagccaattcaggaactggaaagtgcagctgagaaactgaaagcaggacagcttgatgtggaaataaattatgaatctccagacgaactcggaaaacttgccggtaatttccggcaggcatgcaaaactctggaggtgattgtgcaggataccagttatcttctgggagaaatggcagaaggaaatttcaatgtatccagtaataatccacagatttatattggaaatttcaaacagcagtatgagtccatgagcaaattaaaacatgaactgagtgataccatgacacagattcatgaagcatctgagcaggttgcatccggttccgggcagctggcaggcggggcacaggctttggcagaaggtgccaccgatcaggcaggtgcagtagaagaactgacagcaacggtagagagtgtcagcggaattgcagaatccagcgcagagagcgcttccggggcttaccagatggtacgcactgccgtagaacaggcagatcaaagcagagaagaattacaggcattgaccaatgccatggagcggatcagcagtacctcacaggaaatccaaaacatcatcggttccatcgaggagattgcaagtcagaccaacctgttgtccctgaatgcttccattgaggcagcacgtgccggggaagccggaaaaggttttgcggttgtggcagatcagatcggaaaactggcgggtgacagtgcacaggcggcagtcaatactcgcgatctgattgaaaaatctctgcaggaaattgaaaacggaaaccagattacagaaaagacggttgctgcattaaataagattcttgaatccatgaatgattttgcgaatgcggtaaagggcgccagcgagagttctaccgagcaggcaaatatgttaaagcagatcgagcagggaatcgagcagatttccagtgtcgtacagagcaactccgcagctgcagaagaaacttctgcgacaagtcaggagctttccgcacagtcggaaggactgaagaatctggttggcaggtttaagctggcagagtaggagaacataataaaaaggaatcctgtccggaaagatatccggacagggttcctttttttgtaacctttccgatttttcgtttgtattattagtgaaaggcctttggaaatgaaacataaaggagcggctcatgagacaatccgtatagggtaaacgcatttttccgggtggtcagaattccttcgtcccgcattttgccaagctctttggaaagcgcactgcggtcgacgttcagatagtctgccagcccctgccggtcaaacggaatcttaaaataattgctgccggcttttgccgcctggtttgacagatagacaagcagccgcccgcggatcgttttcggggttgtacagaaaatccgctgggagagcgcgagatttttgcgcagggagatctgtagcagattccggataaattttggctgccaggtgcttgcgggatgcggcgtgtggacaagaatatccagattccagaatagaatatcggtctgctgggcagcaaccgcatcgaccatcagtgtttcgcgggaaaatgcataagtttccccgaaaacctgtccggcaccgatgttgctcaaaatgcttttgctgccccacaggtcgagattttcaatattaacgcttccggacagcaccagcccgatctcgtgcgtggtgcatccggcagacaaaatcacttcatttttttcaaaatgtttctggcgcataccgcccagagcgagcatttctttatattctgattcttccatgccaaggcacaggggattttttaaatagatcatgggtttctcctgatgttatttgataaaataagtatatgcaaatttgtgtcacagggcaagaaaaagtgaaccgcccaatggagattctactgtgaaaaatgaggatggaacgtatacatataccgtgtattgtcctgtgaacatgaaataagaacaataaataataatgaaaattataaagaaaataatacattttttatattgattcttggcttgttcctgcatataatataagtgaaattaaacaatggaggtgtctgttatggcaattgcatctgattttttacagagtcttgttccaatttcacaatttaacaaagggcaggctgcaaagatatttgatagacttcgttccgaaaaagaactgattgttttaaaaaataaccagccttctgcaattattctgtcacccgaagagtatacaagattaacggagattgaggaagattattttcttttgttggaagcaaataaacgtttggatgataacgggaataaagagaccgtttcatatgattcagtgatgaaacatttgggcatcagtgaagcagaacttttggaagcggaggatgcagatatcgaatgatatggagtattgagtttttagaggaagcggaaaaggatatgaaaaaacttgaccattcagctcagatacaggtgttaaaaggaattaaaaaagtcagccagaatccgttgtcagtgagggaaggtggatatgggaaaccattgggtaataaaagtggaacaaaccttaccaatcttatgaagataaagttcagagatttggggatacgggttgtctataaggttgagagagtgggcaaagttatgaaaattattgttgtttctgccagaacggatgaacaggtttataacgaggcagcaaaaagaagagataggtatgatttgtaattaaacgggatttccgggcagacatttcatgtccggtgcagaaaatacggcagttctcgctttatgtcgtggtttttgccggaaaaaacaggtattgtaatctgcgaaaggaggagcagatttacatggatggaaagcaagaggagatttcattatggatcagaaaaagacaggttattttttaaaacaactgcgcaatgaaaagaagctgacgcaggagcagcttgcggaaaaatttcagatcacaagccgcacggtgtcacgctgggagacgggaagcaatatgcccgatatcagcatgctgttggaacttgcagatttttatgaagttgatatccgggaaatcattgatggagaaaggaaaagcgagcagatgaatgaggaattaaaggaaaccgtaatcaaagtaacggattatacagagacaaacaacgcaaggctcttaaaacgggtacggatcataggaattaccggtgtgatcacaatactgattgcaatggtcatggacgcaggtggactggcagtgtctccgttttgggaaagtgtgaagcgggatctgtatgcgtggacgcttggcacgcttattgcaaacatactgtatacaacgggatggctcaaacggataagtgagaaaaaagatgtcagcagaacgatgcggataagcggtgtggtatgtgcggtgattgtgattatatcgctggttttgcaggctgttttatagaaaaacacatgacgggaggcaaaagcctcccgttttttatatcacacgcccattttcttctgaaacaggaaatggtcggacatcagaagataatgaagtgattctttcataaaaataaaaagtctcctttgttagtattctaattgttagaaacctaataaataatgttacataaagtgagaaatgtcaaatacaggtttttccacaaaaacaaatgcacaatattgttcaacataactaaaattgtttaaagaaatctaaaatagttgcattttatgttcatcctctatataattttaaatataaataaaataatttataaaattataaaatatagtggagaaaacatatggataagagactgaaatttaatgaaccctggattctgcagagagcagatccgtatgtgtatgaaaaggatggctggtattattttacggcatcggttccggcatatgacagcattgtactgcgccgggcaaaaaaactggcagatcttccacaggcagaggaagtgatcatttggaaaaagcatgagagtggtccgatgagcaagcatatctgggcaccggaactgcactatctggaaggaaaatggtacatctattttgccggtggtgaagaagaggatatctggaaaatccgtccatatgtgctggaatgtcaggggcaggacccattggcagatgcatgggtggaaaaaggcaaaatgcagcgtgcagatggggatgaattctcgtttgaagcattctccctggacgcaaccgtatttgaggatgccggagattattactacgtgtgggcagaaaaggttggagtaggcaagcagatttccaatctttatattgcaaaaatggagtctccgtgcaagctggcaacggtgcaggtgcttcttacaacaccggattatgattgggaacgtgtgggattctgggtaaatgagggaccggcagtgattcatcacggggataaactgtacctgacatattcggcgagtgacacaggagttgcctattgtgtcggtatgcttactgcaaccagcggaacggatctgctggatccgttaaattggagaaaggagcgtcatccggtattacaaagcagttatgaaaaaggaatttacggaccgggacataattcttttaccaaagatgaagatggaaatgatatcatggtataccatgcacgcacagaaacagagatagagggaaatcctctctataatccaaaccgtcatgcacatctgatgcaggttcaatgggatgaaaacggaaagccggtgtttgcgtatgattaagaaaaaaatggttcgtgtgttgaccgttgcagggcttctggcatgccttgcatccggttgcgcctccggcggttcttccgttgggaaggaggccgcagcagatgagataaaaaaaggcggatttacggttgcagcatcctgtcacgatccgcagatcctcagggaaggcgatacatattatatgttcggcagtcatatggtaggggcaaagtgtcaggacctgcgtaaatggaattattttgcaaatggtgttgatgcagcgaatacactgtttgacaatttgctgacagagccatacgctgcctttgattttgtcggaaagaacacagataatgggtattctgtctgggcatcaaatgtaatttacaatgagacaatgaagaaatatgtcatgtatttctgtacgacatcttcttatgtgaaatcgactctctgttttgcaactgcagacaatatagagggaccgtatacttatgtggatacgattttatattccggatatggaaaaagcaatatcagcgaaacgaatttgtacgatgtactcgggaaaaatgcagatatttccagatatctggaatatggtggatacaacaataaggagtggccaaactgtattgatccggcgatttttaccgatgcagacgggcggatgtggatgaattatggctcatggtcaggtggtatctttctgctggagattgatcccgccactggatacccgatttatccggtggatgacaaggatgccgatccgtattatggatatcggctgattggtggtggacatcactctgctgagggtccatatatccagtatgacgcagaaaacggctattattatctgtttgtttcttatggagatctgcagagtgatggtgggtatcagattcggcagtttcgcagtgaaaagccaacgggaccatatgtggatgtggcaggaaatacactggaagatcaggacgatcatttcaattatggtttaaaaatgatggggaattatacattcccgagtttaaattatacctatatggcaccgggcggtcagtccacatttcaggatgacgacgggaaatattacattacatatcatcagcggtttgacgatggcacagagtatcatgaaccgcgtgtacatcagatgtacacaaatgaggatgggtggtttgttgcagcaccatttgccacaatgggagaaactctctcggaaaaggggtacaaaaaatcggatgtatccggtacattttatgtagtaaaccatggaacagatatcagcagtaagattcgcgaagcggaggcatatgcgtttgcggatggaaaagtaaccggtggagaaaaaagcggtacatatgaggtaaaggaaggcacagattacattaccattacactggacggtgtcgtttataaaggggtattaatggaaatgaccgatgaagcggaaaatccggtgttttgtttttcggctgcaggagacaacgaggaaactctctggggcgtacaatatatccaaaaggagtaaagagatatggcaaagttaatgatcaacaaaaataaaaaagaaggtaccattgcaccggagatctacgggcatttttcggaacacctgggcagatgcatctatgaaggactctatgtgggtgagaactctgaaattccaaatgtcaatgggatgcgtacagatgtggtggaagcactcaaagagattaagattccggtattgcgctggccgggtggatgttttgcggatgaatatcactggaaagacggaatcggaccgaaagagaaccggaagaaaatggttaatacccattggggtggtgtggtagaagacaacagtttcggaacgcatgagttctttgaactttgccgtcagcttggatgtaaaacttacattaacggaaatcttggaagcggaaccgtgcaggagatgtcggaatgggttgaatatatgacatttaacggggtgtctccgatggcggatctgcgcaaaaaaaatggacatgaggagccgtggaccattgattattttggtgttggaaatgaaaactggggatgtgggggaaatatgcggccgcagtattatgcagatgagtaccgcagatatcagacctatgtgcgcaattatgatccgcagaaaccgatccaaaagatctgtggcggagcaaatgtggatgattatgactggacaaggaaggtattagagacaacccatgatcacaccgttcctgaatttcatggatttatggatgggctttccctgcattattatgtgcatccggaaggctgggaaatcaagggaagtgcaacggattttgatgaagaagtgtggtataagacattaaaaaaagcactttatatggaaactcttgtggaacgccacggaaagattatggatcagtacgatccggataaaaaaatcggaatgatcgtggatgagtggggctgttggtttacagttgaaccgggaaccaatccgggctttttatatcagcagaacacgataagggatgcgttggttgcagggatcaccctgaatatctttaataagcactgtgatcgcgtgaagatggcaaatcttgcacagatggtaaatgtattgcagtctgtcattctcacagaaggaccaaagatgattaagacaccgacgtatcatgtattccatatgtaccggcaccatcagggtgcaacgcttttgaacagtacactgacaggagtgggcgaaaccggtataggagaatggaaagttccggaggtgacggaatccgtatccgaggatgcggagcatatcattacggttacattaaacaatctttctgcggatgaggaaaaggaaatagagattgcgtttgccggagatgaacacgtatattcagtgaaagaagcaaaggttgtctcggcagagatgcacgcacataatacgtttgatgttccggaacttgtaaaagaagaagaatttactgcatataaaaagtgtggaaatgggataaaagtcatgcttcctccatgcagtgtggtggagctgcgcctgcaataatgcaaaatggacgggattatttatatggaagagtcagagcggtattgcagaaaatgtgaactggcaaaacaatacgggggcggtctggaggaatatcttttgcggtaccttgcacagcttacgccggaagaacaggcagaagatgtgacgtatgcaaggcgtctggcatgttgtgggaaatgcacatggtatggggagcatatgtgccgtgcctgcggatgctatgtgcagcttcgtgctgcggtaaaaggacagaactgtccttatgaaaaatgggaacaagaaggagagacgcatgatacacgatccggcaatattttatgatgaggttagtggaaattattatacatacagtacaggtgctatatgccagaaatcaaaagatctggtgcactggaagaaaatcggaaaagttgtggaacgtccgccgcaggagtcggtggaatggaccggcagtgaagatatctgggcaccggatatcgtaaaggtgggaaaagaatatcgtctgtactgctccaattccagctggggtgtgcgccagtcctgtatctttctggcagtggcagaccgaccggaaggtccgttcgaacccaaagggtgtgtgcttaaaactacagaaaaatttccgcagagtgttaccaatgcaattgatgcaaatattatcgaggatgcaaaaacaggggagcagtatatgctttatggctctttctggggtggctgccatgtattaaaactgaacaggactacaggttttgccgaagaagaaggaatcggggtatgcattgcacgacgcccgaagtggcagagcggcagtatggaaggcccgtatatggtatacaatgcgcagaataattattattatctgtttgtttcctacggatctttaaaatccgattacaatatccgggtgggaagaagccggagtatctgtggaccatttattgatttccacggaaaggatctgattgcggatgaggatgaggataacagcacaggattactcgccatgtgtggatatcaatggaatgaagggcaggcatatatgggtcccggacataattcagtgttacatgatgtaaacggacggtggtatcttgtatgtcatatccgcaggaaaaactttacacaacaggaagaaccgtctgagatgcagatacgtgaaattttctggagcgaggatgggtggccgtttgtggcagcacagccccttgcgaagacagatacaagagacgggataaagccggtaacaaaagaacagatatgcggtttttatgagcggatcacgcttgcgccggcactgccgcagggaattacctgttctgtgccaatgaaacttgcaccggatggatattatgagaactgttctgttcagggaaaatgggagtatactgcagatcacaggggcatgattacatatggaccttatacggaggaggtgcgggtttattgtggctgggatgcacagcggaagtgtgaaacaattctgttgtgcggactgcgcagtgatggtgttgcattctgggcgaaaagaatcggaaatctggtataatggatgctggttaaaaaggcttttgcatggagaaataacatgcaaaggccttttttaataaaattattcttcaattggtgcgtaattaatgctgactttaatatcctgtccataattaccgaaagatttaccgaaaatcgtgagtcctccaacgtgttctgcattgtcattgactgccatgcgcagcttcatgctgctgcgatagtccagattaaagtcccggatggtgacatctgaaatctgcaatccgtctatgaaagttccctttttattgatcacaagcatttttaacaatccatactggttccagttcggaaaccaccagtccggagtgaaaataccgcggacatctccgaaatctcccggggatgtccaggtgccgatgcagacatcatttaaataaaaactgatatcggatggccagacgttattgattcccggggcttcggaactgagctcggcagagattaaaatctgcgtgattttctgggaacctggaataaagtttggaatttcatattccacaaatcctttggaaaaccagagaatatctgcattgtagcgatcaggatgtgcaaagtagcgcgtatcatccacttcaccgatcagatgggaagcggtagccagcccacaggtcggatagacttcataattgcagtaatgtccgacctgaagttctgcattgtaaacattctgcgcttcttccggtgcgtccagatcaatgagaattttatccagatgcagagtacagattttctggtttccgtgcccgctggaatcattggacgtattgacaattccgcatgcctccagtttttttatatgtcccgtcagagcaccgttcgtaatgttcagttttgctgccagttcgttcatgttcatttctttgttttcaatcaacagttttataatttcaatccgaacatcggagccaagtgctttaaaaatgtccagtccatcatccagtgaagtgatgtgaagcataaattaccccctttttatttgttgtttcatttctgttttataaattatagtatcatttccggaatgcgtcaacgcatgagtgaaagaaaaagaataaaaacgaaaataatttataaaacactaaataacaacaataaaataaaatattttaggaaaatctaaaaaatatgctgacatacttattgggcaattatataatgtaaccaataagacctgacaaattttaaaatattagttaatctgccgaatgatttttaaaggcgcgtcggaatcagatggtcagaataacgaacaggggagcttatattttatttcattatgatcaaggtggttaaaaaggagaggaaactatgaagaaaaaaatcatatcaacattgctttgtacagcaatgctcgcaacaatggtagcaggatgcggagttgaaaagagtgatgggggatcagacacagaaggctctgcaagctccgttgcagagatgaaaggaaccggtgataatgagatcaatattcttatttatgcacaggatcacgaaaaagccgtttatcaggaactaattgataaatttacaaaagagcatgcagatgagatttctacagtaaactttgaggtaacaacacaggatgaatacgcaacgaagatgacagctgccatgacagcgggagaacttccggacattttctatgtgggaccggaagcagtcagaagttatgtagataacggatatgtacagccgttggatgatctcgtagatgctactgcggttgacaatctgtggccggcgatcaagagcgcatatatgtatgatggatctaatattggttcaggatcgttatactgcctgccaaaagatttatcctgctttgcatttgcctacaacaaagatctttttgatgaagcaggactggagtatccggatccggaaaatccatacacatgggaagaatttgcagatgtgtgccagaaactgacaaaggataaagacggtgatggcgaaattgatcagtggggtgttgcaaatgcaaatgcatttggttttactccttatgtatacggcaatggcggtcagttcttaaatgatgatcagacaaaggtagtcattgatgaaaatcagaattttaaggatgctttccagtattatacggatctgacattaaagtataaagtaacgccaacggtagaacaggatactgcgcttggcggataccagagatggctggacggacaggttgctttttatgcatgtggtacatgggatgtcgcagcatttatggatgatgcaacattcccatacaactgggatttatgtggatggccggtaggaccaaacggagacggaaagtccacagcatggctcggaaccgttggtttcgcagtttcttcacaggcaaagaacccggatttatgtgcagagttaatacagtccttatcaacagatctggacggacagaaagaactttgcggcgagacatccggtaagtctttacagattccaaacattatggattatgcacagacaacatttaaagacaaagtaaatgatggaacaattccatatgcaagcaatgtagatgttattttcggatatattgagggaagtgacaaatataaaggaatctttacggaaacaacctacacttacaacagtgaatggtgggatactttcctggaaggaatgccgaatgttctgaccggagaagtttccgtagatgattattgtaaacaggtagcgccaaagatgcaggaagcactggacaacgcgatcgaattacagaatgcagcaactaataattaagattaaaacggattgcccctgtcatggggcagtccgtaggaaaagagtgggcatatgagcggaaaaacaaaacaaccgaaacataagatgtcggcaatggcgaagaaagaagaaagaactgcgtggctgttcatcgccctgcctttccttggatttttactttttatggcttatccgatctgctttgcagtgtttgcaagtatgagcaagtggacgggaatgaactctctggtggataatttctgtggattgcagaattacatcaatatttttcatgatgaaaaattctggaaatctctgcttacaaccattatttatctgatcggtattccaatcggaatgatccttggactgcttctggcaatgggaatgaaccgtaagattccgggaatccggctgcttcggacaatgtattatgtaccagtagtatcttcactggttgccgtgtctattttgtgggcatgggtttataattacgattatggattatttaattcaatcatcaaacttttgaccggacatcatggtccaaactggctgggagatgagttctgggtaaaagtagctttaatcatcttcatggtatggaaaggattgggaacttctattattctttatcttgccggattgcaaaacattccgcgtaactactatgaagctgcttccattgatggagcaaatggatggcagaaatttcgtcatattaccgttccactggtctcgccggttacgttctatattttaattaccagcctgattggcggtttccaggtgttcgtggaagtacaggttatgacgaataaaggtggaacaaactatagtgcagcaaccgttgtttattatttgtatgataaagcattttcaaacggacagttaggctacggatgtgcactggcagttattcttgcaatcatcatcttcattatcacggctcttaatttcgcgggtcaggatagatgggtgaagaccatggactaggagggagtcatatgagttcaaaaaaagatttggcaagctcccggcttgtatcaaaaaaagagaaaatttttaactggattatctttgtattacttcttcttggtgcagttgtaatggttttcccgttaatttacatgattgcgacatcattcatgacaaaaaatcagattttgtccggtacattaacaattcttccggatccgattctgataggaaaatattctgaagtattaaaaaagggacagttcataaacggtatatttaattctctgaaggttgcaattccggtattgattattggcggatttacctcctccctcgccgcattcggatttgcaaaaatgagatttcgtggcaaaaatgcattgtttctggcattgctggcaaccattatgattccgtttgcggttgtcatgattccacagtatgtcatgtttaccaaactgggctggaccaatactctgcttccacttattattccgggatgctttggaaatgtcagtattatctttttccttcgacagaacctgatcggaattccggatgatctgatggaagcagcaaaattggatggatgtggatatttccgtacgtttcttcagatttttatgccattgatgaagggggctctggcaacgcagctgatgttgtggtttatgggaatctggaatgattatcttgcacctactattttcttgagaagtgaaaagaactggacattgcaggtggttatccgttccttcaattcctattatgcaattcagagtgattatgctttgatcatggcagcatccgtaattgcaatgattccgacaatggcattgttctttattttccagagaatgatcattgagtccattgcaatcagcggtatcaaataagtaacaaattataaaattcatctttttcaatcctcaacaaaatataagaaagcagttcgtataaaaatcgcttgcgcgatacggactgcttttgtagtattataacgaacagacatttatacatggtaaaggaggcagcgtatgccaaaagaaaatccggtgattgcttttttaaataagatggcagatttgattttactgaatctgatttttctgctgtgctgtattccggttgtgacgatcggaccagcaattacagcattgtatgcagtttcattgcgatcggtacgctatggagatgggtatgttatacagacttttttccgatcgtttaagcagaattttaaacagtcttttgtggcgggaatgataggcttactttttgtgtgcctgctttttattgatttgtttttctggcgcaatgtgggacctgctttcatgtccgtatttatgacagtggtgagtgtatgcgtaggctatttggtttttattgtgttcttatggctgtttccggtgattgcaaaactggaaaatcctttgcgtgtgcagataaaaaatgcagccgccatggcggttgcccattttttcccatatacgctgtttgtaagtgtgatagtactggcggcaggctatatggcatataccagtatcattacggatgtgctgctgcttctgataggatttgctttacttgcatatgtatgttcattctttttttataaagtgtttgcaaaatatatagacgaggaaccggcgggagaggatgacccattatatggaagcagagagtaaaaaatatgaattgaaatttcctccctttaatggtagaataaatgcatagttgcaggcgtacaacggtcgattttttgtgcaatatgtctagtgataaaggcagaacagtggaagacgggcgttgaaattttcattgtggaaagcaccggaaacaaccgtgaaagccgaaatgatttacatagtatatggaggttttttatatggcaagatttacattaccgagagatttataccatggaaagggagcactcgaagccctgaaaacattcaagggaaagaaagcgatcatctgcgtgggcggcggctcgatgaaacggtttggtttccttcagaaggcggaagattatttaaaggaagccgggatggaagtaaaacttttcgagggcattgagccggatccgtctgttgagactgttatgaaaggtgcggcagtgatgcaggagtttgagccggactggattgtagccatgggtggtggttctccgattgatgcggcaaaagcaatgtggatcaagtatgagtatccggatattacttttgaggatatgtgcaaggtattcggcatcccggcactgcgcaacaaagcacatttctgtgcgatttcttcaacttccggaactgcaacagaagttacggcgttttccatcattacagattatgagaagggaatcaagtatccgattgcagattttgagatcacaccggatgttgcgattgttgatccggatctggcagagaccatgccgcagaaactggtggcacacactggaatggatgcaatgacacatgcgatcgaggcatatgtttccaccgcaaactgcgattttactgatccgcttgcgctgcatgcgattaagatgatccagagtgacctgatcccgtcttacaatggggatatggaaaagagagattccatgcataatgcacagtgtctggcaggtatggcattttccaatgcactccttggcattgtacattccatggcacataagacaggtgcagcgtttgcggattatggcgcacacatcatccacggcgcagccaatgcaatgtatctgccgaaggttatcgcatttaatgcaaaggatgagacggcaaagaaacgttacggtgagattgcggatttcatgaaacttggcggaaacacactggatgaaaaggtggagcttctgatcgcacatctgcgcaggatgaacgatgatctgaacattccgcattgtattaaaaactatggtgcagacagcttcccgaccgagcagggatttgtaccggaggaggtattcttagagagacttccggagattgcggccaatgcaattcttgacgcatgcacaggttccaatccaagacagccaagtcaggaggagatggagaaactcttaaagtgctgctactacgatacggatgtcgatttttaaaagaaactaagcaagaaaagccctgcggtttttgtatactgcagggcttttcttttttgcaacaggtgcttcaatgaacaaatatgagtgctgaccaggctaaagtacattgggtatatcaaaaccagaacaaatatggtagaatatacgatatgtaatctgaaaacagatagataagaagatgacaaaaagggtctggaaataaaaaagaagaatccggagttatatcgccggtagggaggaaaatattatcatgagtggatatctgatcaaagacacgacaaaggaagaaaggattgcactgattcgttcctggcaggagccggacgactgcgtgggaggaagcggcatggatctgtttgatatgtatgatgcctatatccgtggggagaaagagattgcagagatcaatggggaatttcaggcatcctatgtaaaagacactgaagacttagaacagccggaagaagcaaaatccacttccggagaactgacgcagctgacaaagcttcatgcggaaggtgcgcttacggatgaagagtttgcggccgcaaagaaaaaagtgcttggactgtagcacacaataattttattataaaaatgcagggcagtatttttgtgcaattcttttagtgacatatgaaaaaacctgtgttacactgaccgtacaagtaaacatacatgatacaactttagtagagaagtccggacaggctgtatctgcttttttaagaggggatatacattatggagagtatcacaggaggaaacacaccaaaatatcaggaactgaccgaacagctgcgtttacagatcgtctccggggagattgcaccggggcagaaactgccatcggaaaatacgctttccgcacagtatcaggtcagccgtcagacggtgcgcaaggcattggcgattttgcagaatgaaggatatatttacgcagagcacgggcgcggtacattctgctcagaaatgatgcggcacgcacatccgtccaagaatattgctgttgtaacaacctatctgtcagactatatttttccccgtgtgatacagggaattgatgatgtgctgaccggtgcagggtatagcattgtcctaaaaaatacaaaaaattcccggacacgggaagcggaatgcctgcaggaaattttaagcaaggatattgacggggttatcattgaaccgagtaaaagccagattttctgccggcatatgaatttgtacgaacaactggaaaaatcgcatattccatacgtgtttatccagggatgtttcccacagatgaaagacaaaccgcatgtgctgctggatgattttcaggggggatatatgatcacaaagtatctgacggatcacgggcacaaaaatatcgtgggagtatttaaggcggatgacatgcagggacagagccgtcataaagggtatgttcgggcactgcaggaggcggaaattttgtatgatccggataaagtggtgtggtttcatacggaggaccgcaaaatccatccctatgaagcaatccgtgaaatggcaggaaaaacgcttcgtgggcggatggatgcggtcgtttgttataacgatcagacggcacagcttgtcatccgtgcattacaggaggaaggactgcgtattccggaagatgtttcggtgaccggttatgataattcttcgctggcgaacaagcaggggcttcggctgacaaccattgaccatccgcaggaaaagcttggcgccatggcagcagaactgctcctttccatgattcagaacggagaaaaagaggaaggggagagtgttctcatccagccaatgcttattgagggaaattcctgcatggaataccggtgacagcttgtgcaatctgaccaaaacaatgccggattaaaacgaaaaaagacaacaattttgttgattttttgcatgaaaaacaacttgtaaatacatgcatacaagttataaacttagagtataaaaacgaacgatataaagcattgattctaaggaggaacgagtatgctgttaaataaggattacaaattttggttttgcacaggatcacaggatctgtatggagaggaatgtctggcaaaggtagcccagcattccaaacagattgtagatgagttaaacaagacaggcgttttgccatatgaaatcgtatggaaaccgacactcattaccaatgagctgatccgcaagacattcaacgaggctaacaacgatgagacatgtgccggtgtgatcacctggatgcacaccttctctccggcaaagtcctggattcttggactgcaggagtacagaaaacctctcatgcatttacatacacagttcaatgaggaacttccatatgataccattgatatggatttcatgaatgaaaaccagtcggcacacggagacagagagtatggtcatatcgtgagccgtatgcgtatggagcgtaaggtcgttgtcggacactggagtgatccggtagtcgttgacaagatcgcaagctggatgcgcaccgcagtcggcatcgtagagagcagccacattcgtgtcatgcgtgtcgcagacaacatgagaaacgtagcagttaccgagggcgataaggtagaagcacagatcaagttcggctgggaagtagacgcttatccggtaaacgagatcgcagagtctgtcgcagccgtatcccagtcggatacgaacgcacttgtagatgaatactacgacaaatatgagattttactcgagggcagagatccggaagagtttaagaaacatgtagctgtacaggcgcagatcgaacttggatttgagcgtttcctgcaggagaagaattatcaggcaatcgttactcattttggagatctgggagcattaaaacagcttccgggacttgctatccagagactgatggaaaaaggttatggctttggagcagaaggtgactggaaagtcgctgccatggtacgtctcatgaaagtgatgaccgcaggcatgaaggatgcaaagggaacatccatgctcgaggattacacctacaatttagtaaaaggaaaagaaggaattcttgaagcacacatgcttgaaatctgcccgtccatcgcagacggcccgatcagcatcaagtgccagccactttccatgggcgacagagaagacccggcaagacttgtatttacatccaaggaaggacacggaatcgcgacatccctcatcgatctgggcaaccgtttccgtctcatcattaatgatgtagagtgcaagaagacagaaaagccaatgccaaaacttccgaccgcaaccaacttctggactccggaaccggatatctacactggagcggaagcatggattcttgcaggcggcgcacaccataccgcatttacctatgacctgacggcagagcagatgggtgactgggcagcagccatgggcattgaggctgtatacattgacaaagataccaggattcgtgacttcaagcgtgatctgatgcttggagaagtattttacagataaaagataggtaacacctgcttttgtaaaatgcaaaggcaggtgtttatgacagaaagagaggtagaaacagtggaaagaaaagacgagattgtgtccgggaaaacatttctcggaattgaatttggctctacacgtatcaaggcggtactgaccgatgcagaccatacaccgatcgcatccggcagtcatgaatgggaaaaccgcctggatcacggaatctggacctataccatggatgacatctggggcggtctgcaggattgctaccgggatttaaaaaaggacgtaaaagaacagtatggtgtgacactgacaaagatccgtgcgattggattttccgccatgatgcacggatatcttgcatttgacaaggctggggagcttctcgtgccgttccgcacatggcgtaatacaatcacagaggaagcagcagccgcactgacaaaggaattttcctataacattccgcagcgttggagcattgcccatctgtatcaggcaatgttaaacaaagaggagcatgtgaaagatatcgcatttttcaccacgcttgcaggatttatccattggaaactgactggggaaaaggtactcggcgtgggggatgcatccggaatgttcccaatcgacagtaatacaaaagattatgatgcagcaatgctcgataagtttgatgcgctggcagaaccatacggctttgactggtcactccgtgacattctgccaaaagttcttgttgccggagaaaatgctggaacgctgaccgcagagggcgcaaggcttctcgataccgatggcgaactggaagcaggaattccggtatgtccgccggaaggtgatgccggaaccggcatggcagcgaccaacagtgtagctgtccgcaccggaaacgtatccgcaggtacttccgtatttgcaatgatcgtactggaaaaggcattaaagaatgtgcacaccgagatcgatctggtgaccacgccatccggagaggcggttgccatggcacactgcaacaactgcacatccgatctgaatgcatgggtcaacctgtttgaagagtttgccaacagttttggcatgaagattgacaagaatgagctgttttccgttttatacaacaaagcactcgaaggtgacgcagattgtggcggtcttttagcatacaactatttttccggagaaggaattaccgcatttgatgaaggaagacctctgtttgcccgcacaccggatgcaaaatttaatcttgcaaatttcatgcgcgtgcacttgtttacggcactgggcgcattaaaggatggtctggatatcctgctcaaagaggaaggcgtacagatcgacaagatgtacggccatggcggtctgtttaagactccggtagtcggacagcgcatcatggcagcagccatcgacacaccggtttccgttatggagacggcaggtgagggcggcgcatggggtatcgcacttcttgcagcttacatggctcagaaagaagaaggagagagccttgccgattatctgaatgagcgtgtatttggcggacaggagggtgtaactgaaaacccggttccggcagatgtggaaggatttgatcagttcctgaaacgctacaacgaagggcttgcaattgagcgtgcagcagtagaacatttataaaataatagttacagataagaaacaggcagaatccgtcgtttacagcggcggattttgtggatatagaaaggacagaaagcatgttagaagaattaaaaaaacaggtttacgaggcaaacatggaattgccgcgcagaggcttgatcacttatacatggggcaatgtcagcggcattgaccgtgagagtggctattttgtcatcaagccaagcggtgtggattacgataaactgacaccagacgatatggtcgttatggatttagagggaaataaaatcgagggtgatttgaagccatcatccgacacaccaacccatctcgaactgtacaaaaagtatccggatatcggcggtatcgtacatacccattctccggaggctacttcctgggcacaggcaggaagggatattccgctttacggaacgactcatgcggattatttctttggaccgatcccatgtgcacgcagcctcacaccggaagagattgacgaggcatacgagaccaacaccggaaaagtcattattgaaaccttggagacaagagggatcaacccggtttacacacctggcgtgctctgcacgaaccatggtccatttacgtggggcaaggatgcggcagaggcagtgcacaatgccgttgtcttagaggaagttgcaaagatggcaacccgtaccgaactgatcaatccgaaggtgcagccggcaccggattgtatccgcgataagcatttcttccgcaagcacggtgcgaatgcttattatggacagaattaaacaatatttttatggtaatattctcaaggaaagagagggatacttttttagaaaagcccctctcttttttctgtgtaaaatagacgattgcgaaaatgtatagagaaaatataatgacatgtgttgatgaaaaacgaatctttcagtatactatatttaattggatgtattgggtaaataaaagcaggagagaaagcgtatgccattagcagaaaaatattcacacacaacggaagaaatttatgcattgccggaaggaaaacgtgcagaactgatcgatggacagatttatgatatggcaccaccgggcagaattcatcaggaactggtgcagcagttgagccgtacgatcggaaattatattgcggatcataagggaacctgtaaagtatatccggcaccgtttgcggtatttttaaatcaggatgataaaacatatgtggaaccggatatttctgtgatctgtgataacggaaagctggatgacaggggctgtaatggggcaccggactgggtgattgagattgtatcacaaagcagtcagaggatggattatctgaccaaattgttcaaataccgtactgcaggggtgagggaatattggatcgtaaatcctatgaaacgtacggtactggtatatttgtttggagaaaatgaggacagcacgcagtatttatttgaagatgaaattccggtgggaatctatccggattttacaatgaaaatttcagaatttgtgtgaacagtatccgcaataagcatttcttccgcaagcacggtgcgaatgcttattacggacagcagtgaaaaatttatgatggggaatgcctgatcccggtaattgtgggatttgaaggctcttgaagtatgaaatgtaaatcaggtaaaaacaggggaaaaagaaatgcctgtttctttttggggattttgtcgctggttacggtagtattgtgtctttcggcatcatgtaatgccgatggaaggaaggcacaaaaatacgagtatggagtattcttaaatgcagaccatacagcagttccaaaatgaaaaaattacgaaattgttgtgattgatgcacagtatttttcgaagaaagatatcagaaaattacatgcagacggtacaaaagtttacagctatcttaatattggctctgtcgaaaatttcaggccatattataaaacatacgagcatctggcaatcggggattatgaaaactgggaagaggaaaaatggattaatgttgcggataaagactggcaggaatttatggatacattagccggaaaattaaagaaaaagggagtggatggcttttttattgataactgtgatgtatatgattatgcccataaaaaggatatttttgatgggctgacggtgattttaaagaaaatccgggcaatggggaagccggtagtggtcaatggaggagatatctatgtgacggcatatcagtcccgttatggttctgctgcggatattatgacgggtgtaaaccaggagtcggtgtggagcaggattgattttacaaccaaaacattccatacgcagaaaaaaacggagcgggagtatttctgccagtatctgcaggcatgcaaagcggatggaatggatgtttatctgctggaatacactacagaccataaactgatccgcaggattaagaagtattgcaggaaaaagaaatatgattactatattgcggattcgctggagctgggtatctaatacaatgtgtttttaaatttgactttaaaaagtagatataatacaattatattgttgcaaaaatgctactggtacagctggaagagcttcataaagttgtcaccgctgtttcagtgaaataacaggaggattagaaccatgggagtacattccatagatgcagaggatgatcagtttgcgtatcgttatgatacacagttactgatcgacagaagagacagggatcttgacgaggatgagatcgcagattacatcacggaaaattttgagggaaacagtctgattgcggctggagatgaggatctggtcaagattcatttccacacgaatgagccgtggaaaattctggaatactgcaatacagttggagaaatttatgacatcgtggtcgaggatatgatccggcaggcagcagggcagcagggataaaaggcagagcgtccgatacagaatactatagtgtgacgctggaaatgaaaagaggtgctgtcgcatcagtaaatgattgatatttactgggcggcaacaccttttttcttttgatgccatgaagtatagaaggctttccttaaatgaactttaaaagttttagactatttagaaaaactttatttgtccctgtgatacagctgcgttacaataaatatatacaaagggcggatggaggaaatgatatggcaaatacaaccaagcttgcacttgaagcatccttaaaagaactcctgcggacaaaaccgattgacaggatcacgatcaatgatctgacggaacattgtggcatcagccgcatgacgttttattatcactttaaggatatttatgatctggtggagtgggcatgtgtggaggacggaaagcgtgcgttgcagggcaaaaagacatacgatacgtggctggagggaattgcgcagatatttgaggcagtattggaaaacaagccatttattatgaatgtataccatgcggttgcccgcgaaaaagttgagcagtatctgtataagctgacgtatgaactgatcgtaaatgtcgtggaagaaaaatgcaaaggcattgcgattgcagacggggataaacgctttattgcagatttttataaatatggatttgtgggaattatgcttgactggatcgacaagggcatgcaggaggattaccataagatcgttatgatgatgggaacagcacttgatgggaatattgcgcggtcgattgagaattttaaacagaaataagaggaaggcggaatatgcattctgcaaaggcttttcagaacttctggagagctttttcatattttgacaaattataataaaaaagacacgttacctacattataacagaaagacacgagcgcattatcctaaaatactataataaaaaaggcttcttctggcaggaaactgcaggtcgtgtttggggaatttctgatagtagaaagaaaacctgtttttagaaatcaggtaatgctagacggtggtggtctgtcgtgggacatatggagaaaaagtgatatattaagtcccggagagagccggctacaggacatatggagaaaaagtgatacattgtgtcccatcataaggaaaccgtgggacatatagaaattttctataaaaatatgtccttttgtatgtgagaaaagggacataaagagctactttatttacatatgtcccatctatctaggcgagagggacataaagagctactttatttacatatgtcccatccatccgggcgagagggacataaaggattactttttgtgtatatgtcccgttcataaacatataaatcacgtagatatataaaattgtaatttcactttaaatccactataactatagccatagtacagcggatttttatggggaggcttctatggcaaacagtttaaaattaccggttggaattgaaaattttgaagaaatccgaaagtttgggtttttataaagaaaatcagggaatggttcagcgatgtgtccaggaatgacggcaaaaaactggaagcgttctgcaatgcatttttggaaaaagatccggaaaaaatcgggcagatcttcggggattatctgtggaacacgatcagcataagggacacggcagctgcaaaagaactggagcagatagaggaaaaagactatgtggataagctgagacaggatggaatgagaaattttatccggtatggaattgcgtgtttcaagaaggattgtaaggttgtggttggagaataagacaggaaaattagtcaaaatgcctgaaatgataaaaattttatcatttcaggcattttgtaaatggtatcttttcacagagatggtaagataaccatatcgtatttgttccacaaatgatctgtcgtgttacaggttttatgattttatgggaattgattttgaaatgaatcagaaacctgtaacgaagaaacactaaatgagaagtatcccagaaatcagaaaggagtttttctatgtcaaataaaaataagaaattaggacttggaatcgcagcagttgcagcagccggtgcaggacttgtatatgcagcacagaaaaccagccagcagaaagcaaagaagattgcaaaggccgcaccgccaatcgattatcgcaacaccgagcgcggaaaatatgaaaagaacagcaaaggcatttattataccaacggaaactatgaagcatttgcccgcccaaagaaaccggaaggtgtcgatgacaaaaatgcatacatcgtcggaagcggacttgctgcactcgcagcggcttgtttccttgtcagagacggccagatgccgggttcccatattcatattttagaggcaatggatgtggcaggcggtgcctgtgacggaatttttgatccgacacgcggttatgtcatgcgcggcggccgtgagatggaaaatcattttgaatgtctgtgggatctgttccgcagcatcccttcgctggaagtggagggtgcatccgtgctggatgaatattactggctgaacaaggaagatccaaactattcgctctgccgtgcaaccgaaaaccgcggcgaggacgcacatacggatggaaagtttaacttaagccagaaaggctgcatggaaatcatgaaactgttcatgacaaaagatgaggatctctatgacaagaccattgaggatgtgtttgatgaagaagtctttgactcgacattctggctgtactggcgcaccatgtttgcatttgaaaactggcacagtgcactggaaatgaaactgtatttccagcggtttatccaccatatttccggtttgccggatttttccgcactgaaatttacacgctacaatcagtacgaatccctgattcttccgatgaagaaatatcttgaggatgccggtgtagagttccagttcaatactgaagtaacgaacgtaatttttgacatcaaagatggaaagaaagtggcaaaagccattgactgcaaagtaaaaggtgtagagaccggaatcgttctgaccgaaaatgatctggtatttgtcacaaacggaagctgtaccgaaggtacgatttacggcgatcagaaccatgcaccaaacggtgatgccgaagtgcggaccagtggctgctggagcctgtggaagaacattgcaaaacaggatccggcgttcggacatccggaaaaattctgttccgatattacaaagaccaattgggagtcggcaaccgttaccacattggatgacaagattcttccatatattgagaagatctgccagcgtgatccgcgcagcggaaagacggttaccggaggtatcgtaagctgcaaggattccagctggctgttaagctggacgatcaaccgtcagggacagttcaaggagcaggacaaagacaaagtctgtgtatgggtatacggtctgtttaccgatgtgccgggtgattttatcaagaagccaatgaaagagtgtaccggtaaagagattacagaagagtggctgtaccatctgggtgtgccggaagaccagattgaggatcttgcagagcacagtgctgtctgcgtaccgaccatgatgccgtatatcacagcatttttcatgccaagaaccaagggagaccgcccggatgtcattccggatggctgtgtcaactttgcattcctcggacagtttaccgagacgccgagagataccgtatttacaaccgagtattccgtgcgtaccgcaatggaagcggtctacggactgctcggtgtggaccgcggcgtgccggaagtatggggaagcgtctacgatgtgcgtgaactgttagacagcagcgtgaagctgatggatggcaagtccccgctgcagatgaaccttggaccgcttaatgtgatcaagaaaccacttcttagtaagatcaaaggaacggtgattgagaagctgttgcgggatcatgatgtgctgcgggatggcatgatttaaaaagattttataaagggaaaaacgtctgagaattttgcataaaacaaatcctcagacgtttttgattactgatgattttgttttttcgcataggtataacctccgtttcgatctggagatattttcgtatgaagttgtgcctatttgatgaaaattgcggggaggacacaaaaagttcacgaatcgacagaaaatcagatgttacatggaagcctgaaaccggaattccccatgatctgcaaagaatccatagacaccatggtatttttcgacaacagagatcatgctctgtacgccgatgccgtggttgacggaacgggatatcggaatatcatctgcaaaaacgacaggttgttcataactgttttttatctggatacataactgtgtatttttctcatataccttaagtgaaatatagcgttgggactgcgggttcatctgctggcaggcatgaagtgcgttttcaagtgcattggcaaataaactgcacagatctgtaatctgaaagcgggaaaattcggtcgcagtaatggaaatctgcattggaatgtggtttacggcagcctgattggcgtaggaggacacaatcagattgaccgattcgttgacacagtagcgaatgacagaactgtgttcaagattggtacagatttcgtggatgtaggaagtcgcttcttttgggttattctgatccagacaactctggatgaaattcatatggtgtcgcaggtcatgccggtaaatggctgcctgctgctgggaagcggaaagctgggcaatttctttctgtgcctgtgtggcagccgtagtaagcagaatattttcccgttctgctttatttttttcacttgaaaatttaagcgagagaacagacagaataaaaaaggatacgacaagaaaactgtccataaagtcaataacgactgcaccgcccgtgtagagcagatccgtgtagacagtaaacgtgtattccaggacatagtataccagcggaagcaggaaaaacaaaagcagtgtcgtgcggctttcatatttcagccggatgatatacggtgagacaaaccggatcacaagaacaagaagcggaatggtaataatgatggaggcaatgttcgatacaacgggatttctgtcaaaaaagaaagcaacaaaggtgccaaaccatttgcgtggcgtgcacagcagatatgcagacaaaacggagatggcagagattgacagattccggtgaaagcgcaggaaaattaaggcaatcaaagggatatggatcagaaacggatagcatttgtaaagcactgattcccccatgatcaggaaaaaaagaagctgggcaatgccaaagaaaaaaagcgtcaggacatagacacgcttatgatcgcaaaaaccgatgtcggcaagatacagtgccgccacgatgccgaaaaataatacaaaagcataattaactaaagaaaaaacggatgaaagttcaggcataatcattcctccatctgaaaagcgagatagtgttttttgatatcggcaaccctgcgctgtgcaagcggaacgtttgtgccgttgtgaagacacatatccattgtgccgattgagcggatatagttcatatttacaaggaacgagcggtgcacctgaataaattcccggtgttgcagaaggctgtcgcatacggacgagaacagttctgtgcagacgatctgttcccttccactcgtgtagtagataactttgcggttctgggcttctacatagatcagttcggacaggggaattttatgtacgccaatccggctttttagtacaagaaaatgcccctgttcctgtgtttttacccgtaggatgtcatccatggcagcaaagaaagcgttggaggataccggcttcatcagataattggtggcctttaccgtataactttccaccgcaaaatccgatgaggttgtaagaaaaataatatcggcagcatggtcgaaagtacggatttcgcgtgcaagctgcatgccggtcatatgtggcatgaggatgtctagcagataaatgtcgaatcgttcctttgatgcccgcagggcaagttcacagctgctgtgatattctttatatgtaagcggaatattgtgagttttctgataactgtccaaaagcgaccgtatgttggacaattccttttcatcgtcatcacatagggcaattttcatagggaatctccttcgttttcaatacatttattataccgtagcatcggacaaattactatagaaatctgctgtcattcacgtagagagaaaaacgggcgtgtgaaaaaacgaaagttttttcatgcgtccttttgcttatagatacaacagtagttatattttataaaaaagtgtatactccccctttccccataagaatgctattatggaatcctatgcggcagttgcgacttttttctgtttattgtgatatttataaagattgtgtccaatagaaacaagaaatacttcaagcaatacagattttatccctcttcggacaattcttttataccaacggtcgttttttatgataccaaatgtaccttcggcctgaatggatctgttcatccttagaagcgctcccttgatactttcgagattttcaatcacttcctgatgcatcgatgtaagttcatggttgagccgaacggtacggtttttatctgtctttttacattgttctgcatatggacagccggaacaatcttcacactgatatacttcttcctgtcgtccatacttgtttccctttacatttttacgatactgaagataaaagcttttcccgtttggacaacgcatgattccgtcctccccgattgggaaatttactgcacgaaatggatcttcatgatacttcttgtcagtagtttctttcttgaacatggggaacttcatatatttttccattccatgctgctcacagaagatgtaattgttgtaagaaccatatccggcatctgcgactggatactttggatagaaaccatatatattctgaaacttgttcattagtggaataaaacagtccatatcggaacggtactgatttacatcaacaacagcaatgtattcatctgcaacaccaacctgtacattataagctggaagcagctggtcatttcccatgtagtctgtcttgattcgcataaaagtagctgaatgatctgtttttgagtagctattacgatcttctccacagatcctgattttttctacatattcttccagcttggcagtatactccctgagtttctcataatgacgttgctgcgtagttttgcgatgtcccctgccatgaacaaacatcgtttcatcaatctgccagacttctgcatactgttcagcagcttctttcagatactctggcgcatactcgctattgatacaaaactttatacccgtacattccagttccttattgatttcctcaaagagtgtggtgatcttatcaaatagacggtatctggatttttctgttgattttttccatacccaggagtatttattcgcatttgcttcaaacttggagccatcaatgtataggtgttggagatccacgtgttctgtctcgaagatttttttgtttatgtcctgaaatatttcttctatggaatcagcaagtacctcgtttataaagtagccgaaggtacggtaagaaggtgtttgatgatccatgagatacatgaagcggagattgactttacactgatcctccagctcacgtaatgatatatagccatttgccataaatccaaacaaaactgtcttcagcatgctgaccgggtcatatctgagtcttcctgtatcatgttgcggaatatttttcagatatttctccagttcgatttctcccataaatctgtcaaatgtcagcaccggatcacagatgtccagataatcttgaattagtattggcaaaactgcctgttttgggttagaatagattatgttattaattttcattgcaagttaattataacagaaagaaagaccttgagttcattataaactcttggtctttcttttttcgggactattcttttttcacagcccctttttgttatgcaccgataaaatcatccgtcagttttccgtgtttttcatagttggtgacccgtgcaatgtgattatccgcatcgacaaaaacaactttcgggtgatgttcttttgcttcttccggtgtcatctgtgcatagcacatgagaatgacatgatcgcccacagcgacctgacgggcggcggcaccgtttaaacagatcatgccggaaccggcttctcccgcgatggtgtaagtttcaaagcggttgccgttttccacatcgacgatctgtaccagctcatattctaaaattccggcagcttctaagagatcggtatcgacggtaatactgccgacatagttgagatccgcctgttttaccacagcccggtgaatttttccttttaacatattgtactgcatgagtaatctcctatttttccacgataaagttatcgatcagtctggttttgccaatgtatacggcaatggctacaagaatggaaccttcgagtttttcgaccggagtaatggtgtcaaagtcaacgacatccacgtaatcaatcttggcaagcggctctttttcaatctctgctgtgattgcagacttgatgacacaagcgcgtgtttctccggcatccacaagggcttttccagcttttaaactgcggtttaacacaagtgccgcctgacgttcttcgccgtttaaataagtgtttctggagctctttgccagtccgtcatcttcacggatgatcgggcagccgatgatccgggtatccacatttaagtctttgaccatgcgacggatgacggcaagctgctgggcatctttctggccaaagtatgcgcggtccggagttacaatgtggaagagtttcaatacaacggtctgcacgccgcggaagtgaatcggacggctttttccacagagttcggtggtaagaccattcatatccacataggaacagaagccatcggcatacatttcctccggttccggatgaaagatgatatctacacctgcagcttcgcacaatgcagcatcttttttgaggtcgcgcggataactctccagatcttcggttggtccgaactgcatcgggtttacaaaaatactgacaacgacacggtcattttcctttctggctgcgtcaatcagacttttgtgtccttcatgcagatagcccatggtcggtacgaatccgacggttaatccttcttttttccatgcctttacggcagcccttactttactgatttctccatatatttccattttatgatctcctgattttcattgtaatttggttttattgttatttgacaaaaacattgcgaatgattccgtaggaatgtcttaatataatttatccagaacggtttcatccattttgaaggtatgctcagcagcagggaacgttccggcagcaacttcttctttataagtgcggaatgcctcgcgcatctgttcaccgacctgtgcaaactgcttgacaaatttcggtttcatgttggaatacatggcaagcatatcctgatagacaagtacctgtccgtcgcatccggcaccggcaccgattccgatggtcgggatatgaatactctcggtaatctttgtggcaagggcctgcggcacacattctaagacaacggcaaaagctccggcttcctcaacggcacgcgcatcatcaagcagtttctgtgcggcagcttcgccttttccctgtaccttaaatccgccaaaggcattgacagactgtggggtcagaccgagatgggcacaaacagggatggaagcgtctacgatggctttgatctgagggcagacttcttttccgccttccagcttaactgcctgtgcacggccttctttcatcaggcgtccggcattgacaacagcgtcatagacggaagtctggtaagacataaaaggcatgtcggtgatgagcagtgtatctttgatgccgcgggcaaccgctgcgctgtgatggatcatgtcctccatggtgacggagagcgtgtcttcgtatcctaaaacgaccattccgagggaatcgccgacgagaatggcattgacgcctgcctcatcaataagtctggcagtagaataatcgtaggcggtcagcatggaaagcttttcgcccttgtcttttgcttcctgaaaagttacaaccgtatttttcatttatgagatcctccattttctttttcctgtttatcagcaagtaaaacatgtctcatgttttcataattctgtgctggattttttccttctgcgattgccagaagccgtgtgccgagcatgcggtacaaagcggcatcttctgtgtttaaacagtgtaagtgcttttccacggttgcgacatctccacgctcgatcggaccggtcagtgcatggacacagccctgcgagagcacattttcgatgttctgacggaccagtgcagcagttgccgcaacggctttttcgcgggaaaatccgcagtcttcgagaagccggtaccccgtatcaagtaccgcgatcacctgattgcttaagatgctggcagctgcatgatattctggcttggctgcggcatcaatccggcagacttcatttccataggaagtgagtaagtcggtgatgacctgtacggcatgtgggtggccttccacggtaaaaaatgcatgttctaattgctggtatgatgaaaatttgttactgaacggtaacatgggatgaaccgagcagcaggatactcctgcttctttggctccggaaaatgaatcggatgaaagtgcgccactacaatgacatataatctgattcctgtgtgacatgcctttgatttcttcccatacgggtacaaggagcgaatcgggtgtcgtgatgaagaggatgtctgattcacgcaccagttgctgcacctgattgaaaccggcagtctgtgtaaacgcggcggcttcttttgcggccgcggtattggtatcataatatcccacaaggtctgcgttcttactccggaaatattttccaagggagcagcctacgcgccctgcgcctatgattcctgttttcatgctaccaccttccttctggtaattaaatggatcggatcctgtgtaacaggtgtccgtcgaaatcctgtgtaaaggtgactcacatattcatttggggcgatacatcataaatataccgcagtcgatacagtttctgtatgaataccgttcagaacccactataacataatcttgggaaaaactcaaataaagttaaagaaaaggcttgaaaatccgcataaaacatggtatagtatatcctcgtgataactattttttccttgttcacaggcataatcctgtgagccagagaccaaaaggaggtaacatttcgcatgaacaagtatgaattagcactcgttgtcagtgcaaagatcgaagatgatgcgagaacagcaaccgttgagaaagcaaaagagtatatcactcgtgcaggcggtactgttacagaagttgaagaatggggtaagaagaagttagcttacgacgttcagaagatgagcgaagcattctactacttcatccagttcgacgcagcatctgatgctccagctaaacttgagcaggatgtccgtatcatggacaacgttcttcgtttcttatgcgttagaaaagacgagcagtagtataagaaagtaggagattgtatgaataaagtcattcttatgggtagattaaccagagacgcagaagttcgttactctcagggggagagttccagtgcgattgcaagatttacactggcagttgaccgtcggttccgccggaacaatgaggatcagacagcggatttcattagttgtgttgcatttagcaagacagcagagtttttggagagatttggccgcaagggaaccaagttcgttctcgagggtcatatccagacaggcagttatacaaacaaggatggacagcgcgtttacaccacagatgttgtggcagagaacgtagaatttgcggagagcaaaaatgcagctggtggaaatgctgatttcggcggtgcaccttctgctccatcaccaagcggagctgccggagatggcttcatgaatattccggatggaattgatgaagaattaccattcaactaaatgctccatagagcataacatcatataggaggttaaagaacatggctttcaataaaacagctgaaggatcttccatgaagagaagaccaatgcgtagaagaaaaaaagtatgtgtattctgtggcaaagataatgtcatcgattataaagatatcaacaagttaaagagatacatctctgagagaggaaagatccttcctcgtcgtatcacaggaaactgtgcaaagcatcagagagctcttactgttgctatcaagagagcacgtcatctggctatgatgccatacgtttgcgagtagacctagtaataccaagggtttcagcgtttggagatgtagcgttgacacaagtttgacacaacatttgaccaacgattcagaagatggatcgttggtcttttttttatgtaatggcatagtgacaatatctaataatgttaagttggtttattatgggaaagaataaaattatggcatattatacttgattaagaactatagcaatgatacaataatgcaaaatgttgacatcaaatacatttttactttccaaaatgttgataatacgcactggtagaaagaaattttgttgatgggggtattatgttaaaaagaaaagcaattgcttcaataaaaaactgggttaacacaaaaaataaaaaatgccttgttgtacagggagccaggcaaacaggaaaaacatatattattgaacggtttgcagaagacaattatgaggaactgcttgaaatcaactttaagcagatggtttctgccgttgacattttttccggtgatcttacagtagataatatggttatggctatgcgtttccgctttcctgaaaagaaaattctgccagggaaaactttgatttttctcgatgagattcaggagtgtcaggaagcaatcacatcccttaaattctgggcaatcgataacagatatgatgttattgtgtcgggctcgcttcttggaatcgattataaacgtgcatcgtcttatccggtcggttatgttgattatctgagaatgtatgggattgattttgaagagtttctctggggaatggggatttctgaagacatgatcggaaacctctgcggatatctggaatcaaagaccgtgatacctgaggcgattcattcccaaatgatgaattattacagacagtatatagcaataggtggtatgccggaagctgtacagaaatatgtagatacaaaggatttcagagaggttgataagatacagaggagcctcttattgggatatcagtatgatatagcacattatgcaactgcggaagaaaaggtaaaagcagagaaatgttatctttcacttgcaaagcagctgcttgataaagaaaaccacaaatttcaatataaagaagttgagcatggaggccgagcacaaaagtatttttcaagtattgagtggttgcttcgtgcagatatggtacatttaagtaaacttgtgacggatgtcagatttgatctggatgattatgcaagagatgattttttccgggcttatacaactgatttatcattgttgatggcgatgaaggacttttcattaaaacagcatattgtagaaaacactttagagggaaattccaaaggcggtatctatgaatatgcaataacagatgctctgtataaaaagggatatcagttatatttttataaaaatgagacaacgaaaagagaaatagatgtagtgatccaaaaagatggaatggtagttccgattgaagtaaaaggcggaaatacgagggcaaattccttaaagtcacttatgaagaatcataaagatatttcttatgggtataaatttgcagatggaaatatcggtgtgggcgaagatggtatcattacattgccgctgtatatgattgcatttatttaattcatccatcttccacgtttggccccgcctcagatatgggaaagagttctgccagctttaagaccggctgccttttgggatagccggtccttttgtatgtttctaagataaattaatcaaagatgatcagagccataaatacaaccggttcattgccaatcggttttaaagcgtgtccgcatccgtctggtgtataggttacatctccggcttttacagtgcgtgtggttccgttatcgttatattctgcggtaccggaaagaatgtaatacgtctcgctttcatttttatgttcgtgataaccaagagaagatcccggctgaatggttacctgtgcatacagaccacattttccgtttaattctttttctccgaggatgcgtttgatggttacttcgccatctccgccggccatgtttttaactacttctgttactgtttccattatgagtacctccttgtgtagtggtttatgccattactatagcatagtttgcacaaaagataaatcttattatacggcttttgcctgtgtctgtctggttctggcttcggtcattgcataaggatcgagaatagaatccagttcgctttcttttaacagaccgtatttcaatacaagagttttaactggaatatctgtttttaaggattcttttgccagacttgcagcttttttgtagccgatgtacggacacagggcggtggtgataccgacgcttgcatcgagaagttcgcggcagcgtttttcatttgcggtgatgccgaggatgcagttggcggtcagagtatccactgcgtgtgtcagtgtggtaatggagtcaaaaagattgtaaaaaacaaccggttcaaaagcgtttaattccatctgaccggcttctgccgccatagtgatggtcgtgtcgtgaccgataatatgaaacgcaacctgtgagacaacttccgggatgaccggattgactttgccgggcataatggaagaaccattctgcatagccggaagtgtaatctcaccgaacccggcttttggcccgcttgcaaggatacgcagatcattacacattttggataagttgaccgcacatgctttcaggcaggaggaaacgcgtacaaatccgtccagattctcggtggcatcaaacagatcgtcggcctgggtcagtgggtagccggtgatttttccaagggttggtacaatattatccagataaaacggggatgtattgattgctgtgccgatagcggttgcccccatgtttacgggatacatttccgtgcggacttttgtgagacggtcacggtcacgggaaatcatggtggcataagaatggaacgtctgacccagacgcatcggcacagcgtcttcaagctgtgtacgtccgatttttacaatgtggtcaaacgctgcagctttgtcatataaggcatccgttaaaagggaaaggcttttgtctaaaggtttgagaagatcgagaaccgttaattttccggcggttggaatgacatcgtttgtggactgtgccatattgacgtggtcgtttggatgaacaatggtgtagtctccttttttgccacagagcatttcgatggcgcggttggcaatgacttcgttcatgttcatgttggcgctggttccggcaccgccctgtatgccgtcgacaatgaattctttgtcaaacatgccacagaccacttcgttacatgccgattcgatggcgttggcaatttccggtttcaaccttccggctttccggttggtaatggcggctgcacgttttatttttgcaaggtttttaatgaaaacggggtgtaaccgggtgccggtgatcgggaagttttcttttgcccgtaaagcctgtactccgtaataagcatcttcgggtacttccatggttccgatggaatctgattctaaacgcatgtattctttcataatttgatctccttatattcttctgttatcagttgtctgtttttgtttcttttctgcgcgcttttttcaatgggacgagaatagcactcctgacatcaaaggtaaatactttaagcgatatttggaaaaacagccagaaattaagagatatagacaaataaaataaagaaaaaatagaagaaacctaataaaataaggcaattttacaggagcgagatataaaaaatgagctgttattggggattgcaaatgtaaatacctgtgctataatgacctcataatttaaaaatgattgtgaaaagaaggacacaggcgtctaagcaggtgtccttctttgcgtatttatgaaaaaatcgaggtttgtgtcatgaaaaaactggataaagtagataaaaaaattatacagattctgcagaaaaatacccgcacaccgctcaaggagattgccgcacaggtatttttgtcatcgccatcggtgtctgcaagaattgaaaaacttgaacatgagggtgtgatcatcggctacacggcaagggtaaatccgcagtatcttaattatcatattaaggctttcatcaatctggaggtggagccgctgcagaagccggtattttatccgttcattgaaaaaattccaaatgtggtggagtgcaattgtgtgacaggggattattcgatgctgattgagacattgtttgagaccacggcacagctggatcattttatcaatgaactgcagcagtttgggcgtacaaagacgcagattgtgttttctacatctgtggaacagcgggaagtgccggttgtgacggaggagaagtagaggctggttgcattccttatagaatctggcgtataataagatcactgaaataacagaaaacagggataatgattgtgatgaaagagaatcaggaccgtaacatacaaaatgtatatcggcagatagtggaaatttcaaaaaaatatcaggtaaaaaaagtagtattatttggatcacgtgcgcgtggaactaatatgccaaaaagcgatatcgatctggcgatttatggatgtgcagattttggaggtttgtcagatagtttaaatgaagatctgtggtcgcttttaaagctggatattatcaatatggatgataaatacgtgtcatctgaattggtatccgagatagagaaagatggggttgttttatatgaaaaagtttgatcagtatgttagacatttgcaggtgctttgtcgggcagaacaggaagatgtatggctggaaatgttgcgtgatcgaaatgatgccacacatatttataatgaagaagcagcacagcaactggttgaaaaaattctgcatcagtatattggagtgtttgtctcgttggaacagcagatccgtgcccggtatggagatgaggtgttagaacagctatgacaaagtggtatcgtgcgtgtgtgaactacattcattctgtgccggaatataactgtgcacccgaacaggaacgatttacggaaaaagccgcaattgcagcaatacataaattaaaacgctattatgatgaaaagcattttgtaaaagatccggattatatggtgcggatggatcggctgctttcggtgattaaggatcatgagacggatgaagagatggatcagtggaaggtctggctgaaatattttgtcactatgggtggcggtgagtggaatgaattctggggagatgtgaaataagtaaggggagaaaaataaattctggaaagaggttaatgagaacaattaaattttcagaaaacctgtcaaatcaaatttgaggtttatgatttttgaaaatattttacgaatcaaatatttcaaaacgttaagatgttacagttaaaaagccaatcatacagaaaaatgatgatgagagataatctgcttgcgaaataagaaaaaggatgttaacataatagctatcggaaaagtttggagaaagaaaaataaaaagatcggaggtgaaagaaggatgacacaggaagatattgtgattttatcacagttgttagatcagaaatttgaacctgtatacacaaggcttgatttactggagagtgatgtcagggaactcaaaagtggaatgtctgaaataaaacagagagtagccagtgtggaacagaaagtaacggaactggatcagagagtagccagcgtggaacagaaagtaacggaactggatcagagagtagccggagtggaacagaaagtaacgaagctggaacagaaggtaacggaactggatcagagagtagccagcgtggaacagaaagtaacgaagctggaacagaaggtgacggaactggatcagagagtagccggagtggaacagaaagtaacgaagctggaacagaaggtgacggaactggatcagagagtagccggagtggaacagaaggtaacggagctggatgaaaaggtaacggaactagatcagaagtttacggtactggatgaaaaggtaacggtattggatcagaagtttacggtattggatcagaagtttacggtattggatcagaagtttacggtactggatgaaaaggttaccggtttggaattggtaattgaaaatgaaacaaatgtaaatatcagacggattgcagaagggcattgtgatttagtgcgtaatttgagggaagcacgcaaagtagatgatgaaaaagaattgcttgccattcgcgtgacggtgttagaatctgatatgagtaaagtaaaacatcagcttgcaattacataatcttgcggatcgcggtgcctcggcaccgcgactttttaggatggggaaaatatgattacattgaatgattacttatattcgggggatacagttcttcgcattttaaaaaaatacatagcggatttacgtatttcggcggtacagaaacataatgaagtggatttagtgcattgtgactttttgatacagattatggaacttttggaacacaatgatttcctgacttcgcaatcgcagaagattcgtgagttttataaatatatggcacaggaatatccatatttatcttttactttcaagggacgaattaagtcgttgattcgcgcagagggaaagtttaatggatatattgtggaatacatatacgattattatgaaaagaatggatcatatccgtctgtgtcagaaatcaaggagcgtttgaactgttttcgcgatttgatcgcgtaccgtattgtgatttccatgccacggtgtcatatgaaacaaaaacaggatcgcaagaaggaagagatcaggtatttatatcggattgccaatgtattgccacaatttttggaagaacgtggatttacggcagagtcgacaggtggggttaaaagaagtaattctttactattggatgatgctgtgcgcccatattacagggattatattgatggggaaagtacaaattcatatcgttcgcttcatataacgttttttgacaacagtgcccggtgttatatggaaatgcagcttagaacaaaagagatggatgatattgcagaaattggagtagcgaatcatttattttatgaaaaaaaacaggaaacttccagaggacggagagatgcgattttacaaggcggctgtatttattttgacgaggcttatgagcgttgtagattgttacagaaccttgatctgtcaggggtagatgtaaatatgtttacggcagtgaataatagccttatgaatgatggatgtggtctttttcgggggcggctgattttgccgtatgagcatttatcaaaattccagaatgatatgattgattaaaggagctgtaaaataagtccctaatataagaaacgccaattccggcacaaatgtcggttttggcgtttctttgtattaacttttctatggcaatccttccgcaggcttgttttattttatatatggaaccgtttaatgccaggtcaatgctgaaatcaatcagaccggatttaatacatttttccggttcttttctttttttgatgttttcattttgggaaccttttcctttttggaaaataaggtatgttttttctgcaattttccacgaatttctgcacttaactggcggtagcgttcctccgtcatatcgttttgttcccggatgagatagttcatttctttcaggacggtttcacggatttctttgctgatatcgagtgtgagagcttcgttattctgtgcgattgcgtgccctacaatgtcactcatcaactcccgaaattgtgccatgcgttcttccgcggaaagggtatttacaggtaagtcggttttatctgtattctgtcgatccggtttggcgacaaccgtgtgatgatgttcccggttacatgcgggcaatggaccaggtgctgcagaatccggcacggaaacaccggcatcttcggggtttttattgtgtaatatcatgcggattgccttcagctggtatcctttttctttgagttctttgatcttttggaattcctgtatgttctctcgtgtatagtatcgatgtcccatctcgtttcgcgggatggtcaggtcgagttcttcttcccagtaacgtaacacatgggtttccacaccggccagtgcggcggcatcggaaatcatgtaacgtactttttccacgataacatgtcctccttttgagttatttattttgggcgatttcacaatcgccttttgcgtttattataactttttaaaaaggtgagttcaaacattttccatcgtatttttctgacatttctcgcagtttgtaaaaatagaccttgacatttgaggtttataagtataaactgaagacaggttgatagctataaacctatggaggagaaaaagatggaatatataaaattatgtgacagtgattaccggtttatgtgtgtcgtatgggagcatgcccccgtcaactccggggaacttgtaaagttatgtcaggaacagcttggctggaaaaaatccacgacttatacggttgtacggaaaatgtgtgaaaaaggatacattgccaatgaggatgcaacggtttctgttttaattccaaaggaacaggtgcaggcagaggaatcccggtattttgtggatcgcacatttgacggatcactgccagggtttatcacagcatttcttggaggaaaaaaaattcccaaaaaagaagcaaagctgctcaagaaaatgatcgacgagcataaagaagggtaggggcagagaatggagaaggcaagtgtaatttttctggcatttctgcagcggaatggcatggtggcggttgtaattctcgcggtgtttgcagtgcgcgcgcttttacggaaatgtcccaaaaaatattcctatgcattgtgggcaattgttggaatccgtatgttatttgatttgcccattgcatcaggatggagtttgtttaatctgtttcgtctggtaaaaagcagatcacaaatgagtgagattgcacactacacaggagtatctggagtgcatgcgcaaacggcagtacagaatgtgacgcagatatctgccggttcacgtgtgacaggggatgcagcttctgaagctggtttgacagcagctatgacgacctcacagaaaatttgtgcggtgttgttttttgtctggctgatcgggatatttttatttttaggatatggaatgtattcctatatcaaatgccgcagtatggtacggacagcagtacgtttaaccgtaaatgaaacatctggaaacgtccggcggaccataaagatctgggaatgtgactgtattccatcaccgtttgtactgggaattttctgcccgcagatttatattccgtttcggatgaaagaggaggaacagcagtacatccttgcgcatgagagctggcacatccgcagacatgatcctttatggaagctgattgcattcgtacttttggctgtatactggtggaatccattggcatggattgcctttttctatatgacaagagacatggagatgagttgtgatgaggccgtacttgcgcagtttggaaatcagattaaaaaaggatacagcgcatccttacttgcttttgcgatggagcggcatccgtattcatttgccccggttgcgtttggagaggcagatgcaggaaggagaattaagaacgtgttgaattttaaaaaaccacatacctgggtggctgcgattgcaaccgttttggttgcacttgtggcagtaagttgtctgacaaaccagaaaccgtcggagacaaaaacagagcatacaaccgagaaagtggatagtacacagcagccagtgcaggaaaatgcaggagctgcgataatagagcagaatatcagggaatgggcacaggcattttgcgaccgggatacagaaaaaattgtgcagatgacatccaaagaggtacagtcgaatttagagaaaatacatattttgtggatggatggagatacacagtcatttggctggtcgagtccatggccatggggagcctttggcagtttctttggtggaaccggagaagaaatggatggctactggctgcatgaaatcaatacggaagaacagactgcagagattttgtattatgtggagtcatcagatccgcatgtgagcgtgtggatagagaatatccattatgcacaggaaaatggtcaatttcagattacacaggaaaaaatcaatcagtttgctgacggtctggatgctaaaacggatggaattgcatcggcagatgagtttgatacagcatatgcgcaggaaatcagcgatacgcagatggactactgtataaacggtatgggtgaagtgctgaataagaatatggttccaattggtgcattgcttgagccgacagatgcagcccggcagcttttgaatttatcgtcggataaaaagcttgtttccgtggaaaaagaatctgaatctgcagataaaacacaggtcggtatacagattacatttttaaaggatggacagaagcggtatttgtctatgatccagccatggggaaaagatggaatctgggttccggcagaagccaaagaagtcaagcgttaatgtgtggatgttatcatattttccttgtattgcatcttaagttccgttataatttgaactggtacaacaaaataattaattatttattgtcctggataaaggagtatagttatgaggatgttaattgataacagagatctggaattacttcttgaaaaaaagaaaaagtttattggaaataaagttactgtggatacaatgattgcaggaatttcttttttgttgtccgtatttactgcaacatatagtgattggtttggaattccaggaattgtgtttaaaacagttttttgttttattggaattttatattgtgccaagatcgtaaaggatattgttgaaatgtacagagataaatataatcacgaaatgttgatgaatgatataagagaactgaatttaattcagcataatcactcattaattgctattcgtgatacatttgaaaaagaaaatagatttcttgtttattatgatgagagatgggattgcaagttgtttttaaattataaaaccgtggatcagaacaatgaagatgtaataatagatcgaatatcggctgatttggatgtggacaaaagaaaagtatcatgtaattatgttacttcaagagttcaggaaaaatattcagttagtcatcaggaaaatagaatatataatcatagactttatgaggttacattatcaaaatattcggaaaaaatgaaaaaggatagttttgtagttaatgggaaacgctattattggatgtcagtaaccgagatggaaaaagacgaaaacatcatggaaaaaaatcgtgaggttgttgattttgtaaaagaaaaaattgtttgacaaactgtgattgtctttctataataatataattatagaatacaagcgaagatgggaacaagtaccaatgtgtggaacgaacagaaagcagccggtagatgagaggcacacggaaagcacagatggatttatggaaaaaccataagccgggcgataaggaatccccccagcaggctgggtcccccctgccacggcttatgaaacaaacataaaccgagcgataaggaatccccccagcaagctgggccccccctgccgaggatttatggaacaaacataaaccgggcgataaggaatccccccagcaggctgggtccccccttaccgcagggaatacatccctgagctttacaccgaacgcgcaggcaagtaggctgtaacggagtagtgcccgttagacgcactggagtgtagctgcactcgcggaggcaggctgtgtgaacagcatgcgaattaaggtggtaacacgagagatccccctcgtccttataattaggacgaggggatttttatttggatttttatagatatggagcaaagggacataaagccccagaaaaatcaaaaaagttaaattacaggagggaaacccaatgacactttacgacgaactggttgcccgcggtctgatcgcacaggtaaccgacgaggaagaaatcaaggaacttatcaacaatggaaaagcagtattttatatcggttttgacccgacagctgacagtctgcatgtgggacattttatggcactgtgtctgatgaaacgtctgcagatggcaggaaacaagccaatcgcgctgatcggcggtggtacagccatgatcggtgatccatccggacgtaccgatatgcgtcagatgatgacaccggagaccattcagcacaacgtagactgttttaaaaagcagatgagccgtttcatcgatttcggagaaggcaaggcaatgctggtaaacaatgccgactggctgatggatttaaactacattgatgtactgcgtgatgttggtgcacatttttccgtaaaccgcatgctgacagcagaatgttacaagcagcgtatggaaaaaggattaagctttctggagtttaattacatgattatgcagagttacgatttctacacactgtaccagaaatatggatgtaacatggaattcggtggagatgaccagtggagcaacatgctcggtggtacggaactgatccgccggaagcttggaaaagatgcgtatgccatgacgatcaatctgcttttaaactctgagggaaagaagatgggaaaaacacagtccggtgccgtatggcttgatccgaacaagacttctccgtttgacttcttccagtactggagaaatgtggcagattccgatgtgttaaagtgcatccgcatgctgaccttcctgccattggagcagatcgatgagatggacaaatgggaaggtgccaagctgaatgaagcaaaagagattctcgcttatgagctgaccaaactggtacacggtgaggaagaggcaaagaaagccaaagaggcatcccatgcactgtttgcaggcggcggggtttctgcacatatgccaacggttgaagtgactgcagatgatctgtacaatgacaagctcgatatcatggcagttcttgtaaaggcttctctgtgtgagagtcgttccgatgcacgtcgtgccgtacagcagggtggagtctctgtggacggtgagaaagttacagacatcagtaccagttacacgctcgacgagtttgccggagaaggaaaggtcgtaaagcgtggtaagaagaagtttgcaaaagtcatcagtaaataagaagttcgtattgactaactcaaagaccgtttgttatagtttacctaattcatagacaaaagtatgtgagggagtagttcgcacattgtgtgacttgtcaacataccggtcatttggacctggcaagccttaaagaatgagactcatgtgcaccggaaaccgtggctgcagtcgcggttttcgctggtgcgcattgggtctctttttgatatataaggacagaagcgcaaggtatgaatcccctcacaaaaggagaacataagaatggtaatcgagttatttctgattggtgtcggactctcgatggatgcatttgcggtatccgtctgcaagggtcttggcatggaaaaaatcaacaaaaaacatgcgtttctgattggattgtatttcggaggatttcaggcactgatgccgtttctcggctgggcgctgggaatccgctttcagaaatacattacttcggtcgatcactggatcgcctttttcctgttgctgtttatcggtggaaagatggtgattgaagcggttcgtgataaagacgtgcaggaaattggagcaaaagatctgccactggatcacaaagagatgctgcttcttgcagttgcaaccagtatcgatgcacttgcagtcggtattacatttgcctttttaaatgtatccatcatggaagcctgtctgattatcggatgcacgacatttgtattatcggtcatcggagtggttgtcggtaatttcttcggtacccgctacaaaagaaaagcagagattgcaggtggggtaatcctcatacttattggtttgaaaatactattggagcacttgggcattattgccttttaacacattattttacagaaagagggaaaagatatgacagaatttatttcaacatgttccatgccgctggcaattgtttttttgatcgcaggatttttcttcctggtcaaaggggcagatgtttttgtggaaggaagttccagtattgcaaaacggtttcatgttccggctattattattggcctgacgattgttgccatgggaacctcacttccggagactgcggtttccgttgttgcagcaatccagcataagaatacgctggcaatcagtaatgtggtcgggtctaatatttttaatatgatggtggtcatcggtttttgtgccataatgactccggttgccgtacagaaagctacattgaaacgtgatttcccatattccgtgtttgcagcgttgctgcttatgatactcggtggtgtgggaatgaaactgggacgttttgacagtgctgtatttctggtgttttttgccatatttatcggaacaatgattcgtatggcattgaaagcaggaaaagaaggcgggcaaccgcaaagtgaagagattgaagcggcagaggcacagaaagtaatgtcgatgccaaaaagcctgttgttccttgtggttggtgtggccggtattgtgatcggcggggatgtggttgtggacagcgccagcaatattgcattaaaaattggaatgagccagacgctggtaggactgaccattgtttcaattggaacctcgcttccggaacttgtgacatctgttgttgcagcccgcaaaaatgaagtggatatggcacttggaaatgcgatcggctccaatatttttaatattctgtttgtacttggtctggctggagttatcagtccgatgccgtttttgatggaaaacatcatagatattatgattctgattgttttgagcctgttgatctgggggtttgcatggacaaaagaaaaaatcagcagaaaagaaggtattgtgatgctggttttatatgtggtttatgtgatttatatctgcatgagatagaaacttctgtgacaggatgaattttggaaaatagtttttacaggggacaggatatcaggactttaatttgcagaaggttttttgacgggaacatcaagcacgcgttttacagcactttgtagttccggatgccggcgatacatttcgatgacatgccgttcatctgcagtgatcgggaaggatttgtctgcagggatgtgcaggagatttccggtgaatgtgtcactctgatacagttcacagagcagcagcagtgtttccgtgcggggataggcctgatcgctttcccatccgtatacggttttttcggcgactgcgatattgtacaggtcattcagctgtacaactacgtcatggatcgtccagccacgattttttcgcatcgtctttaaggctgccccgatttgtatatttttcatgttggtgctccttctcatttatctttggcagttttgtactggaaaaaactggataaaagcatattagtctacggaaaaacaggtcagcaagaaattcttggcatataagaaaatattcttgaataaacagaaaaacggacgaatgggggatactttacaaatggcgtggaattcggtaaaatggggagagcgaatgtgagataaggaggccaaaaacatggcagaaaataaaggaaagttttatatgacaaccgcgattgcctatacttcaggtaagccgcatatcggaaacacgtacgagattattcttgcggatgcaattgcgcgttataagagagccgaaggctatgatgtctattttcagaccggaactgatgaacacggacaaaagattcaggaaaaagcagaggcagcagatatttcaccgaaagaatttgtagatcaggtttccggtgaggtaaagcggatctgggatcttgtgaattcttcttatgataactttgtccgtaccacggatgaggatcatgagaaatgtgtaaagaagatttttaaaaagctttatgatcagggtgacatttataagggatcatatgagggaatgtattgtacaccttgtgagtctttctggacagaatcccagcttgtagacggcaaatgtccggactgtggacgggaagtgcagcctgccaaagaagaagcttatttctttaagatgagtaaatatgcagaccggctcattgattatatcaatacccatccggacttcattcagccggtttcccgtaagaatgagatgatgaataactttctgcttccgggactgcaggatctgtgcgtatcacgtaccagtttcagctggggaattccggtagattttgatccgaaacatgtcgtatatgtttggctggatgcactgacaaactatatcacaaagattggatatgatccggatggttccacagatcagtttaagaagctgtggccggcggatctgcatctgatcggaaaagatattgtccgtttccataccatttactggccaatctttctgatggcactggatctgccactgccaaagcaggtatttggacacccatggctgcttcagggcggggataagatgagcaaatccaagggaaatgtaatctatgcggatgacatggtagatctgtttggcgtagatgctacccgctattttgtattgcatgagatgccgtttgagaatgatggcgtgattacctgggatctggtcattgagcgtttcaactctgacctggcaaatattcttggaaatctggtaaaccgtaccgtttccatgagcaataaatattttggcggtgtggtcacatccacaggagtcaccggtgaagtggatgcagatctgaaagctgttgtgacagcaacccgtgaccgtattgccgggaagatggcaaaacttcgtgtggcagatgcaatttccgaagtatttgcactgttccgccgttgcaataaatatattgatgagacaaccccgtgggtactggcaaaagacgaggcacagaaagaccgtctggcagaggttctttacaatctgaccgagtccatcacgattggcgcaagtcttctgcacccgttccttccggaaaccgcagaaaaaatcgtggcgcagttatcgacatcattgcgtgattttgatgaactcaatcagtttggcctgtatccggatggaacaaaagtaaccgatgccccagagatcctttttgcaagaattgacgcaaaagagatccagccaaaggtggatgccattcaggcaaagcagaaggaagagtacgaaaaagagcagaaagcattaaatggcggagagacagcagatgaagcagtgattgatatggatccgaaggaagagatcacatttgatgattttacgaagatgcagttccaggtgggagagattctctcctgtgaggcagttgcaaagtcaaagaagctgctttgctctcaggtaaaaatcggaaacactgtaaagcagattgtatccggtatccgtaaagattacacactggaagagatggtcggcaagaaggttatggttcttgtgaacttaaagccggcaaaacttgccggagtattgtccgagggcatgctgctgtgtgcagaggatgaaaacggcacactttctctgatgacaccggagaaaccaatgccaagcggtgcagagatctgttaaacaaggccggaggcataaaaataggaggcataaactatggaaatccttgatgttgtagatgaaaccggagcaccaaccggtgaaaccgtagaacgcacagaggcgcaccgggagggtgtgcggcatcgtacatcacatgtctggattgcccgcaacaggaacggacggattcagcttttgctgcagaagagatgtatgcagaaagattcatttccgggctgctatgatatttccagtgccggacatataccggcaggggaggagtatattccttcggcaattcgggagttgaaagaagaattaaatgtgacagtgcaggagtcggatctgatttattgcggacaggtgcataaggatgttgacagcgaatttcacagacagccatttcatgatcaccagatttcaaatgtttatctgctctggctggatcgggaagcagaggaatttgaactgcagaccgaagaaatagagagtgtgcgctggatggattatgcccaggtgcggggcatggtggcttcggatacacttccaaactgtatcatcatggaggaacttgatctgatagaaaggcacttcttatgatttttgagacacatgcacattacgatgatgcaaaatttgatacggaccgggagatgctgcttgcggaattaccgcagcgcggcatttcgccggtgattaatgcagggtcttccattgcgacgacaaagacaacactttcgctggcgcaggaatacccttttctttatgctgcggtgggcgtacatcccagtgacgtggatgatttaaatgaggacacgtatgcatggctcagacagcagacaacgctgcaaaagacagttgcggtgggagagatcggactggattattactgggataaggaaccggagatacaggcgaagcagaggtattggtttgtacggcagcttgcactggcacaacaggcagatcttccggtgatcattcattccagggatgcagcagaggataccatgaagatcatggaaaaggcatatgaggatggcataaagggcgtgatccactgttattcctattcgccggagatggcacaggaatatgtaaagatgggatatttcatcggtgtaggcggtgttgtgacttttaaaaatgccagaaaactcgttcagacggtagaggaaatcccgctttccgccattgttttagaaacggattgtccgtatatggcaccggaaccacaccggggaacacgcaatgattcacgcaacattccgtatgtgattgaaaagattgcaaagattaaagggatttccgcggaagaagtggagaaaaccacacgggaaaatgcatttgcattgttttcgaaagtaccgcgataaaagggagagaatattatggatgagtacgaagtaatcagcattccggtttcggatggcacggaaaaagaatttgccatcatggatacctttacggttgagggaaaaagctatatggcggtatcccttattcaggaagatgagattcaggagggtgtgtatttataccgttatcgggatgcagaagacggagatattgtggtggagcagattacggaacccgcagagtataagcgtgtatccagaacatatgaagcgcggtaaggctgcaaaagaaggatgagaaagatgaaaaagtggaagaaaaagcgtgtggtggcggtgcttttgacactgcttgtgctgttacagtttccggcagactttggaagtgtggcacatgctgcacagaaaaaggaaatcaggggaacgatttcggtagcatccaatatctcccagcaggatatgcagcagtacctggatgggtttaacaagaaatatcctggtattgaggtgaaatatcagtcgtactcggattatgacaatgaggtgtcaaaatagattcaggatagggattatccggatgttttatttgttccgggatcggtgccgggagcatttacgacaggaaagaactgccgtttctgtttgcaatcatggatattgataactttaagtctgtcaatgatacacttggacacgccggaggagatgaggcgttaaaacttttagcggatacgatgcgtctggtgtttggaacacatgtccttatggcgcggtttggcggagatgagtttgtactctgtatacaaaaccgtgatcaggagggtgttcaggcacagctggataaactggtcagaagcacgtgtcagacatttacatatggcgggtgttcagtgccgctgtctatcagcctggtgctgtgtatatgacggagaaagttccttatgaaaaactgtttaaggaagcagacagtgtattatatgaggtaaaaacccgtggaaaaaacagttttgagattcggaaaatttgaaaaatgatataaaatgaaatcccggagcatgggaaatggctccgggattttttcgaaaatgattaatttttatttggaataaacgggctgatcgctccggcgagctgtgcaaccggcatgctctgcagccatacacgtcccggtccggtgataacggtattaaagatcccttccccgccaaagagcatattttttacacccggtacagtctggatattgatggaacatccggctgtcattgccgcgagatatccggtatcgacgacaatctgttgtcccggtgcaagttcatattctttgatgtgtccgtcaaattcgagaaagacggtgccgtttccggacagacgctgcatgataaatccttctccaccgaagagaccgccggcaatgcgtttttggaaaaaaacagacatttccacaccagcggtcgatgcgagaaatgcacttttctgggcgacaatctcctgccctggtgcaatttcaaatgcacggatatctccgggaaagctggatgcaaatgcgatcagtccggtgccgccctgtgcggtgtaacggttgataaacatgctttcaccggaaaaagcacgaccgaacatttttccgattccgccgcctgttgtggtttccattttcatatttggggacatccacgacattgcgcccttctccgtgagcatggtttcgccgccctctaagttgcagattacgacaggcaatggtgccccttcaattgtatagttcataactacctccctgatatattgtttttcgttacaatatcatcttaacggaacatggggatcttttcaagaaaatgtttttggaatggagagtaaatcatgacagtgtatttcggtgaccgtttaatgaaaggaaattgtaattaccctgtcaatcagttatactatatgtaaatatggcaaaatgatctgtttgttggaggttcatatggtaaatactttgaaattaccggtaggaattgacagttttgaaaaaatacgcaggaacggatttgcggatgcgaagaggatgctcggcacgattcttgccaatgaaatggaccggcattattatctcaaaacaagtgatgcacttacggacgaggataaggcatgtttcaagaaggattgcagggttgtgattgctggttagcaggaaggaaacaaacatggcaaaagtaatcatggtgcagggcacgatgtcaaatgccggaaaaagcctgatcgttgcaggactttgccgtatttttgcgcaggatggctatcgcgtggcaccgtttaaatcacagaatatggcactcaactcctacatcaccgaagacggtctggagatggggcgcgcgcaggtcatgcaggcggaagcggcgggtgtgaagccttccgtgcttatgaatcccatcctgttgaaaccgaccaatgatgtcggatcacaggtgatcgtaaagggtgaggtgctcggaaatatgcgggcgcgggattattttgggtataagaaaaagctggttccgacgatctgcgaggctttttcggagttggaaaagcaggcagacattattgtgatggaaggggcgggaagcccggcagagatcaatctgaaatcggatgatattgtcaatatggggctggcaaaactggtcgatgcaccggtgcttctggtgggggatatcgaccgtggcggcgtgtttgcgcagcttttgggaactttgatacttttagaagaggatgaaaaagcccgtgtgaagggtctgattattaataaattccgcggggacaagacgatccttgatccgggagtggagatgctggaggaacgcggcggtgtgaaggttgccggagtagtgccatatatgcatctgtccattgaggatgaggacagtctgagcggccagttggacaaccacgatgtaggcgtgatagatctggcagtgatccgttttccacggatctccaattttacggattttaacgtgtttgaacggctggagggtgtgtccgtgcgctatgtttcttcggtgcaggaactgggacagccggatatgatttttctgccgggcagcaaaaatacgatgggtgatctgcgctggatgcggcagaacggtctggaagccgcggtcaaaaagctggcggtgcatatcccggtctgggggatctgcggtggctatcagatgctggggcgtaccatttcggacccacatggggtagagaatgagaattcgctacgcgaaccgctctatccggctcattgcgaagcaatttctcatgagccggatacaattgccgtggagcgcataaggcgcgacggggcactacccctgcgtggtatggaactgccccctcgtgagactcggcggcaatcgcacgcagcggatgagaattcgctacgcgaaccgctgcgtggtatggaactgatcgacaccgacacgaccctgatgccggaaaaaatgcgtacgcagacacgtggaaaatttgagaatgtaaccggtattttttccacactttccggattggaattttccggctatgagattcatatgggaaagacaacggtttccaccggggaacatcagacgccactggtacagctggcagatggcagaaccgacggggtgcagcgcatggaaaaaggcagcgaaacacccggcgtatacggcagttatgtgcacggcatttttgacgatggagacattgccgtgcgcatagtacaggcattggccgacaaaaaaagggtgtcatggaaaccggaggctggcggtgattaccatgcatttaaggaacagcagtatgacaagctcgcacagggattgcgggagcatctggatatggagtatgtatactctattttgcaggagagccggatttcctcttgatttttacaatgttatagatcccgacacaaatcaggacaatggataataccagaagaatggacagtgggtattcgaaaatatagtgataggaatcggcatatgcacgaccatagagatccatatatttgaattgttcccattgacccagaaatggaagcacacacaacaggaaaattccggttatggtcataaaaataaagggagttcttttagcaggattttggattttattttggttttctgctgaagcatctggttttttgagcattgtgtcaattggaacatggaattgctcactgattaagagcagggtatggatgtttggaacagagattcccatttcccatcgcgatacggcctgacgagtaacgcctaatgtttgagcaagctgttcctgggaaagatgatgtttttgtcttaaatcaagaagaatgtgagcgatagtttgattatcaattttggttttattcatatcagcacctcctttttcttatcatacatttcatggctgaaagaagcaagaaacagggaattgcatttgcgcaatttacaattgcaacaggagaaaatatttgattacaggaaaagaattagagaaacttaaaatcattccaccggacgcacagatctacgcgcaggtaaaagcaagctgggacaaaattgccaaaccgctggatggtctggggcagtttgagacaatgtttgcgcagatcggcgcaatcacaggaagcagcagcctttccattgaaaaaaaagtgatcctcaccatgtgcgcagataatggcattgtcgcagaaggagtcagccagtccggacaggaagtgaccgcggtggttgcaggatttatggggcagcaggcaagctcggttggtaaaatggcgcgccgcgccggtgtggatgtgatcccggtcgatattggaatcaacacaaaagaaacgatgccgggggtgcgcgactgcaaagtgatgcagggcacgcgcgattttctgcaggaacctgcaatgacagaggaagaagcgttgcaggcattgtctgtgggaattgatctggtccgggagtgcaaagacaaaggctatcagctgatcggtaccggagagatgggaatcggaaatacgacgacgagcagcatgcttgtggcggcactgaccggacgcacagcagaagaagtgaccgggcgtggtgccggattaaacgacgcggggctgttgcgcaagcagcaggtcattgcgcaggcactggagaaatatgaaaaagagatccggtcaaagcatgcactttccatgctggcggcattcggtggtctggatatcgcgggaatggcaggtgtatgcatcggcggagcactgtatcatgtgccggtcgttctggatgggctgatctcatcggtcgcggcactggtggcggagcggatcgtgccgggtgtgcgggaatttgttctgccgagccatctgagcaaagaacccgcggcaaaatggatcgcggaggaactgaaacttcatccggttattgatgcaggactggggcttggggaaggcacaggagccgtgatgctgttttcccttctggatctggcactggcactctacgaggatcagacaacatttgatacgatggaaattgcgcagtacgagcggtatggggaaacagaatgatcactttggttttgggcggaagcggcagcggaaaatcggcttacgcagagcatctgctggatggaaaaacgaataaatattatatcgcaaccatgcaggtgtacgatgcggagggcggaaaaaaagttgcaagacaccggagacttcgcgcgggaaaaggatttgttacgatggaacagccgcgggatatcggggaagtagatttttcgaaaagagcacagcaagccatggaaccaccggatcgcgcagggcaaaatgttacggaacgtcctcgctgtgccctgctggaatgtatgtccaatctggttgcaaatgagatgttttccggtgcggacatcatttcggaagatgtggttgtcggacacatattgcagggaatcaaaagcctttccgcaaaagtggacgagttggtgattgtcagtaataacgtgtttgaggatggcatttcctatgatgcgacaacgcaggcatatatccgtgcacttggacgcatcaatacgggagtggcggagctggcggatacggtgaccgaagtcgttgtaggtattccggttccggtaaaagagagaaaggaagcaggttatgcacatcattagaggaatcgcggtggcgttttccacctattcaaaaattccgatgccacaatttgtgtggaaagaagaagacatgcgttacagcatgtgcttttttccgtggatcggggcagtgatcggtgctatcctctggggatggtttcggttgtctgcgttattgggaatcagtacgcttgcatttattctgatatcagctgcgctcccgcttattatcacagggggcttccatgtggatgggtttatggataccatggatgcattgcattcgtatcagcccagagagcgaaaactggaaattttaaaggattcccacattggagctttttccgtgatcaagctggcggaattcgggttgatttatgtggcggctctttcccagattgtggattaccgtgcgctggaagtgttttgctgtggatttttcctgtcccgctgcctgagcggcctgagtgtggtctccttccgttccgcaaaaacggatgggatgctctatcattttgcgagtaccgcacatgagcgcggggtaaaaggggcactttatgcacagacgttgttgtgtgtactgtttatgctctggctttcgcttctggcgggaattctggcggtggcggcggcatttgcagtgttcggttactatcgctggcgcagttacagggaatttggcggaatcaccggagatacggcgggatattttctgacgctgtgtgagggggcaatggcggtggcggcagccgtgtcagtgttgatttgaaaaagtcgcgctactggtgcaagaaggatgatgaattggggtatacttgaaattggtgattgtgtatgatataatgcaatcaacaaagaatgaggcgatacttttacaagtacaccaaaaacgaacccccagtagttgccgctactgggggttcttctcattttgtatggtcgagcatccattcaggttaattgccgctaatatagcataaatagataaatttgttgaaacgtggtaatataaaatatcaagcaatagggagtacattaatggaattatacattggcggaactgctcagggaaaaaaagcatatgtaacacaggtgcggggcatcgaggaagcacggatctgggacaattttgaagaatggtttcgaaagaaattgcaggaaagtgccccgaagtctctatccccggaagcagaaagtatggcttatctggaaaaacatccggatacagtaattatctgcgatgaagtaggcaatggaattgtgccgcttgattcgttcgagcgggaatatcgtgagcggctgggacggctgctttgtgaaattgcagcaaaagcagaaagggtggaacggattgtatgtggaattggacagagaatcaaatagaactgtatctgatccggcatggaatgacgccgggaaatgtagaacaccggtatattggcagacagacggatgaaccgctttcggaggacggcaggcagcagctggagaaaagaaaagaccaatgggcacaggtatgcaggacatgggatatgccatatgtatttgtaagtcccatgcttcgctgccggcagaccgcagaaattttatttccgcaaattccacagatcgaaattgatccatggcgtgaaatggattttggagaatttgaaggcaggaattatgcacagctgaatggagatccacgctatcaggcatggattgacagtggtggaacgctggcatttccgggaggtgagagccgggaggcttttatcgcaagatgtgtggatgggatggagctggttatggaacagatccggcagcagctggcatacagagcgtgtccaaagtgccgggaaacggaagacaacggtatgatacaggagccgcttccggtggcggctgtggttcacgggggtacgatcatggcgctgctttcgcactactgtggcggtgattatttttcgtatcaggtaaaaaatgccgagggctatcatctgcgcctgtacttacaagagaataaaatggagttaaaagaaaaagtatgagttatcatttttttgcgatgtttcttgggtttgtgctggatctgttgtttggcgatccgcactggctgcctcatccgatccgtctgattggtaatctgatcgcatcactggaaaaactgaataaaaaggaactgtcagacacaaagaaatttctgcgcgggtttgtgatggttgtggttgttatcgcatggacaaccggtgtgaccgccgttatccttgagggggcatacgggctgcatccggcgattggctgtgctgtggaagccattatgacctatcagattcttgctacaaagtgtctgaaagtggaaagcatgaaggtatatgagcagctgcaaaagcagaatctgccggcagcgcgaaaggcagtgtccatgatcgttgggcgtgatacggaacaactggatgaaacaggtgtggcaaaggcagcaattgagaccgttgcggaaaatgcatccgacggtgtgattgcgccgatgatttatctggcagccggcggaccggtgcttggatttgcctataaggcggtgaataccatggattccatggtgggatataagaatgaaaagaacctgtattttggaaggtttgcggcaaagctggatgatgtggtaaatttcatcccatcccgcgtggcggcactgcttatgatcgtggcgagcttccttccggggaagcgttttagcgggaccggggcatggaagatctggagaagggacagccggaaacatgccagcccgaattctgcgcagaccgagagtgcctgtgcgggaagccttggcatccagctggcaggggatgccagttattttggaaagactgtaaagaaaccgacgataggggatgccctgcgtccggtgaaaccggaagatatccggtgtgcgaatgtgctgttgtaccggatggcattccttggcatggccgtttgcctgtcacttttgtattttctgtaaacagtaaaaagccggacgttgtgtaaacagcgtccggctcagaccgtagacaaagtgctccgagaaacttccgtttctcggagcatttttctttgtgtttatgaaatttattccgaaaacaggaaattttcccttggattatgccatccgtaatccccattcctgcttgcattttgcaagcttttttaaattcatgcacgcaaacgtaagcgcgactttcattgtcatccgcgctttgccatacaactgcgtatatcgaaatccgtggttttcctttgccgttccaaagattctttcaatcgtttcttttctgtgtgagtatagctccttcattccttctgtatgccggatatcctcacatgtttccatatagtcttcccatacatgtctcgtaacaacttttacatggttcttgctttctgtacactgcgaaagatactcgcacttttcgcaaatctgtccacagcttttatactcgcgatatccgtcccgatttgtcgtgctgtaatgcagaaagtgattccctggacaaatataagcatcattatactcatcatatacatactcagatttcctgaaaaagccatcctttgtcatgggacgcttgtaaggaaagaccggctttattccatcatccaaaagtagctttgctattgcaggagttttatacccggcatcaacgatacagtatttcatgccgatatctgcaagcttatcgtaaaggcctttaaaagttcgactgtcatgctcattaccagggtttactgtaaaatcaataatccatccatttttatcgcatgctgtttcaatcccataagcaaacacatgcttgtgctcgcctttccgaaaccagccgctctcaggatctgtagtgctacacttaattgttttttcatctgacggaacatcatccgtataatcttcaaacttgtcgttgccaccggaaccaggtttgttgttatcgtctttatctttcaacggtttctttccgtgcgcttctctgtctgcgttaatgtcctgacgcagcatgtcagcataaaataaagcttcctgttttgcgattcgtttctgcatctttctgttgttcgcccgcgctttcacatgtgttgcatcaacaaaaatctctgttgaatcaaccagtttgaaacggtaacactcctcaaggatacgctggaaaatctgctcgaataagtcggtatctttaaaacgacgggtatagtttttcccgaaagtagaaaaatgagggaccggatcataaagttcaagtccaaggaaccaacggtaagccatgtttacttcaatctctttgattgtctgccgcatgcttttgattccatacaggtattgaataagcggtatcttaataagcgtaaccggatcaatacttggtctacccattccgtcggaataagtatcacggacgagatcatagatgaatgtccagtcaatagctttgtcaataagtcgtagaagatgattccgcggaacaagatcatcaatacataccatctgcatttgctttcttactttttctgtttcttgtgtcatcatagaacaataccgccttttttgatacctttattataccaaaaagagactgaaaagtcttgaaaatactgacttttagcctctttaatacagaaaaatcctcggcaaaaagccgaggactttgtctacagtctgagccggacgttgtgtaaacagcgtccggctttttggcagacagagttatccgagttctttgtgctctacggaatctttcatatcttctgcaagcatgtaaatattctccagaacttttttacagcccttcatattgtccaccgtggaatctgccatacgcagcccttcggtggaagaggcagccacttcctcaccggtggcggagaggtgggtaatattatcggaaataacattcgtggcatcaaggattttctggatattttcttctgccgtatggatatcttccatcaggcgttcaacggtttcaccgacattgccgaatttctcccgtgtattctcaatcagttcgttctgcttttctacggaagcaactgagttttcgatactttcgttggcacgttttgtgtcatcgtttaatttgtcgataatttctgtaatgttggcagaggcattttttgtctgttcggaaagctggcggatttcatcggccaccacagcaaacccttttccggcttccccggcacgcgcagcctcaatggaagcatttaaggcaagcagatttgtctggttggaaatttcaataatggatccgacaaagctctggacatcctcgacttttgaagtcaggctctggatgacctgtaccgtgatattgctggcttcttccacgttctgtgcctgttcctttaattccaggacgacctgtgcaccggattttacagtagcatccgtttcatgtgcggcttcaatcatctggtggatgccggcttctgccgcatcggtgttgccctgaatattggaacacataaccgcctgtttctggatggcttcagcggtgctttcggtgctgtctgcaatttcctgaatagaactgtggctgacctcaatactgttttccaaactgtcaagcacagtcattgcttcttcaaaatgccgggaaatattttcggcaacgagaagcatctgatcgtggtttttcttctgcttatccgcagcttctgtaatttccgtcatgttttcatcaaagaaaagcacaagcatccgtgtaatactgatagaagcgtatgcaacaagaagcaggacaaacagtgccagcaccttgttggccagtgcagcagatgcgtgtggggcaaaactgagcatcagacgaacgatatttaccagcagaaatacgctgtttattattttcataagccgttcattcagataaaccatggcggcaataatgaggggaagcgcgtaagcccatgtcccttccgtggtatttagtaaagcaacagctgcataaccgaccatcatggcggttgtcaggatgatggcacaggtgtgcgttttctttcgggtcagatagcccagtgcggaaaggataatcacaccgaccgaaaccagacactggatcataatccggacaaagtggtccccgtggctggccgccagtgcagcaagcatggtcagcgtgatataggaaaagataatggtgacagcgagaaatacccgcttgttggctcgtaaatactgtttttcgttcatgtaatgttctccttctgccaaatatgcaaaatcgttaaattgtataataatcatacctctcataaataccgtttgtcaaaggaaaacagacaaaaaacagactttgtggattatttgccaaaaaacagttttaaatcatcttctacggtaccaattccggcaatgccaaacgtgtccgtgaggatctttgccacattcggggaaaggaatgccggaagggtcggtcccaggtgaatattttttacacccagcgccaacagtgccagcagcacaatcactgctttttgctcataccatgcaatgttgtagacgatcggcagatcgttgatatcatcgagaccgaatacttccttcagtttcagggcaatcacagccagagagtaggaatcgttacactgtccggcatcaaggacacgcggtattccgttgatatcgccgagattcagtttattatatttgtatttggcacagccggcagttaaaataaccgcatcttttggaagtgctctggcaaaatccgtatagtaattgcgggagtttgcccgtccatcgcatcctgccatgacgacaaattttttgatcgcgccagagttgacggcctcaacaatctgactggcaagtgcaagtacctgattgtgggcaaagccaccaatgatttcaccgtgctcgagttcttccggagcagaacagtgtttcgcctgttcgatcagtgccgagaaatccttctgtgcaccgatttcgccatcaatgtgtgtgcatcccggatagccggcagcaccggtggtgtacagccggtctttgtagctgtcctttggtggaacaatacagttggtcgtcatcagaattggtccgtggaaacgttcaaattcttctttttgtttccaccatgcatttccgtaatttccgacaaagttcggatattttttgaatgccgggtagtagtgggcaggaagcatttctgagtgtgtatacacatctacaccggttccctgtgtctgttccagaagcatttccagatcttttaaatcatgaccggagacaagaattcccggattttttccaacaccgatattcactctggtaatttcaggattgccataggcaccggtatttgcagtatcgagcatcgccatgcctctgacaccatagtttccagtttccagtgtgagtgcgatcaggtcatcggctgtgagggaatcatccagtgttgcagcgagtgcccgctgcaggaaggcatcgatttccggatcatccgaaagcagtacattggcgtgcttggagtaagcggacaaaccttttaatccgtaagtgatcagttcacgcagactgcggatgtcctcgtcttttgtggagagaacccctgcctcttttgccttggcaaagagcacatcatccgatgcgtcagagccatcttttgtttttatatcccagaaagcagcttccggcagacctgagggatcttttacctgtaaaatgagtgtgcggcgcacggacagagtgttatgaatccgtgcgatgatcgcctcattgtcgaagttggcatttgtgatggtggtaaacagattccaggtgatcaagtggttggtttcttctgaaacctttgttccttctttgcgcagctgggttgtgaccgcggataatcccttgctcacatagatgagcagatcctgcatagctgctacttccggctttttgccgcagacacccatctgggtacagccgctgcatcctgcggtttcctgacactgatagcaaaacattttatgttccataataagatactcctttgattttattttgtaagcaagaagtaatttatcagaaagcaaatggaaaatatgttgttaaaaccacaattgacgagaaaatgaactggtgataaatgggaatatgcagtaaaataggaaaaagaaaagctacaggaaaatcatatgggggattacagatgatgaaagaatatattatggcactggatcagggaacgacaagttcccgctgtatcctgtttgatcatgcaggaaaaatcgtcacgatggcacagaaagaatttacacagatttacccgcagccgggctgggtagagcagaatccgagggaaatctggtcctcccagatgtcggttgccatagaggcaatggcgaatatcggggcatcatccaaaaatatccgtgccattggcatcacaaaccagcgcgaaaccacaatcgtctgggataaaaagaccggggaacccgtatacaatgcgatcgtctggcagtgccggcgcacggcagaacagattgatgaactgaaagaaaaaggatatggaccgatgctgcagaagcggacaggcctggtgccggatgcttatttttccgcaagcaagatcgcatggattcttgatcatgtgaaaggcgcgcgtgaggcggcagaaaaaggggaacttttgtttggcacggtggatacatggctgatctggaatctgaccaaaggggcggtgcatgtcacggattatacgaatgcggcaagaaccatgttgtttgacatacacagatgctgctgggaggaagagatattagagctgtttcgcattcccaaagaaatgctgccggaagtgcggccgtcgagtggtttcttcggagagacacaggagcaggtttttggcggtaaaattcctgtgatgggtgtggcaggagaccagcaggcggcattgttcggacagtgctgttttgaaaaaggggatgtaaaaaatacctatggaaccggttgttttcttttgatgcataccggaaaggaaccgatcatttccagacatggactgcttacgaccattgctgcgggtactgcaggggaagtggaatatgcacttgagggaagtgtttttgtggcaggggcggccatccagtggctgagggacgggatgcgtatgatccgtaccgcaggacagtccgaggaatatgccaagagagtcccggattccaatggtgtttatattgttcctgcatttgccggcatgggggcaccgtattggaatccgtatgcgcgcggaacgattgtcgggctgacacggggatgcaaaaaggaacattttatccgtgcgacattagagtctattgcctatcaggcgaaagatgtcattcacgccatggaagaggatgccggcgtgacgctgaacggtctgcgtgtggacggaggagccagtgcaaataacatgcttgtacagtttcaggcagatatcattgatgcggcagtacttcgaccggaatgtattgagacaacagcactcggagcggcatatctggcaggacttgcggcaggttactggaaagacagggatgaaatccgggaaaactggcagctgggacgaaggtttgaaccggtaatggactcaggggagcgcaaaaagctgctcaggggatggcagagagccgtgcggtgcgcacggctctgggcagaagatggggaatcatgagatttatttgtttaattccgttttgatattttcgatcaatggatcagcctgttccatcatattggaaatgtcctcatagataaatcccttttctgtcatcaggctctttaagccgtcaatatcggactgaacctgggcataacgggtttcatgggcttccatgtcttcccggagctgatccacctgtccgctgcagttttccacaacctcattgatgccgcggtgaacattttctacgccggacacagaatcattgatatgggaaaagatattttcggttgtgtccatctgtgtgcgggaagcatccagtgcatcctgtacatccagcagagaatgcgtcagattttcggagcttgtctgcaaaccttccatacttttgtttacatcacccaccagttctttgatgccaatggaaagttttgtgacttcatctgcaacaacggcaaatccttttccgtgttcaccggcacgggccgcttcgatggaagcatttaatgccagcaggttggtctggtttgcaatgccgacaatgttttgcatggttgcatggatttcatcaaagcgggcctgaaattcatcgtagattttatgaatctctgcgaactgcgtttccactttggcagagctttctttcagatcacggatatcctgcatggcatcatcggatacgctggtcacaccggtgattacatctgtaaattgtctggaaatttctccgattttcccgaattctttttgcagggaatcaacagcttcgcggatcgaggcattgtgttcaatcacgtcggtgtaagagtcttttactttatcaatctcacgcacggtcttgatttcttcttcaacgagagattcctttttgtcaatgacaaaatggctgagaaaagacatggatgtcagacagtcttctattttctttttattggaaacctgtggaacaggtgttgcggttcctgtggttttcttttttccaaacataaaaggttcctcctattcaaataccacgcagaccatcgtctggtttacatgctggttattatactgttcgccaccgccgacaatgccaaggtgtggtccgagagaggccatgtcttttgcatatgtagaaaaatatccctctttttcgtagagcagataccggtagatacagtcaatggataaaaccagggaaatatgggatgcgtcctgctggatctgctggcgtgtctgctgttctgttgctttgtagtcaccgaggcttaagaaataaatgcagtcgtttttattgattcgtttgtagttggtcagtgtgccgtctgtatccattccgttcatggaagagataaaaacctgattgcccaccgcacgtcccataggattgaccagtacgttgtcaacgattttatcacggggaatgccaagttctgcgctgtatacgtctgcggcgggtctgccgtcaagttcgatgagtgctttacgggacacatcgacttttgtggcaaagtgactctgagccgatgttttttcatagatgttttctttgtatacacgtatttttccggttgtatttttgatcagtgcatagacgcaggcatcttcatataattctccgttatatgcaacgaccggaggtttgccgtccgggacaccgaaaacggtgcctcctgccagatggatgccctttgtttccagacaggatgtaaacgtggttaccagcttttcttcggagccggtacaatattccacgcataccgtatcgtctgtgccgggagaaatctctgcaatctgcttcagaagctgcgttgtgcccgcaaccggacaacggctggcttcggtgatgataccacagcggatcttcacatcagaaaaaaatccaagaaccgcaagaccggaatcattcacctgtccgtttacgagtctggttccgatcgttccgatacacggagtatccggaaaaagttcttttaagcgtgaggcagtttctttgaaatgttcataagaagccataaaaagaattgcacttggggatgtaagtccctgtactgcctgatgcacggcagcttccggctgtcccacacctgtgccgatgaatgttttcatggaaaattcccccttaaatctgatctgtttttcttatagtatattttttttgatttaaaatagcaacagaattttatgttttcaccgacaaaaatgatttttttcttgcacttgtttcctgttttgcgtataatttttaatgtgcgcgtacaaagcacatttgtacgcaggaaaagccttttgaaaaaggaaaataaggagaaaaattatgtggacaacaatcaatgcatttttaaagaccgtggacaacttcgtctggggagtcccgcttatggtattgattctctgcggtgggatcttactgaccgtgcgtctgggagtcctgcagatgcgcaggcttccgctggcactcaagtggatgatcaaaaatgaagagggcggcaagggagaaatttccagttttgcggcgttatgtacggcactgagtgcaacgatcggtacgggaaacattgtcggtgtggcaactgcggtatgtgcaggcggcccgggggcattgttctggatgattgtggcggcatttttcggaatggcaacaaaattttccgaaggattacttgccatcaaatatcgtgtagttgacaaagacggacacagtctgggtggcccgttctactatattgaacagggaatggggtcgaaatggaaatggcttgcaaagatttttgccttttttggagtctgtgtaggtctgttcggaatcggaacattcagccaggtgaacggtatagccagtgccatccagaacttttttgatccgaataaggttcataccgtggcaattccgggaatcggaacttattcctggacggttgtaatcgcttccctgatccttgcattttgtgtgggtgccgtgctgattggaggaatcaagcgtatagcaagtgtcagccagattgttgttccgtttatggcggttgcatattttgtatttgcattgattttaattatctgtaatattacaaaagtccctgcagcggttgttacggttgtgcagggcgcatttcatccgcgtgcagtcaccggtggtgtggtaggcagtatgtttgttgccatgcaaaacggtgttgcaaggggcattttctcaaacgaggcaggacttggtagtgcgccgatcgcagcggcagcagcacagacacatgagccggtgcgtcagggacttgtcagcatgacaggtacatttattgacacgattgtgatctgtacactgaccggactttccattgtactgaccggagcatggcaggtggatggactcgagggcgttcaggttactacatatgcgttccagaacggacttccgttccctcatgtggtatcttcttttgtcctgatgatgtgtctggtattttttgcctttacaacgattcttggatgggattattacagtgagagatgtctggaatatctgaccggtggaaatatgaaaaaagtaatggtgttccgttggatttatattctggcagtatttatcggaccgtatatgacggtaagtgctgtctggacgattgccgatattttcaatggtctgatggcactgccgaatatgattgcgctgtttgctttaaatggtgtggttgtatatgagacaaagaaattttttgaggctggtaaacataaaaaatgaaaatatatttaatcaggcacggagaaacggactggaatcatatcaaccgttttcagggaagggaagatatagaactgaatgcggcaggaattgcacaggcagtacgctgtgggcagacgctgcagggactggggatagaagctgtgtatacaagcccactgaaacgtgcacactgcacaggggaggagattgctgcacagatcgggttaagcagagacggtgtagagccgatgcaggagctgattgagcgggatcttggtccgttttccggacaactggtaaaagataaaaaagagtattttgcacttgcggcaggcgaccatgtcgaaggaatggagccgtttgccgatgtgcagaaacgcatggagcatgcgatggagcttcttgcggcaacgggacatcaggcagtggctgcggtatcccatggagcggcaatcaatgtgcttctggcagggcttacgaatcatgagatcggaaccggaaagacaagactctacaatggggcaatcaatgtgattgaagggtcacagaccggaggatttcatgtcctgcactgcaatctgccgccggatgatcccaagacacggcagattctgctgcaggatcggtaaagcagattttatcatgcagttatggatacaggaggacaggatgggatacgagcggctggaaaaaagtctgacagacacgatcaaagaggaacaggcaaaactgggattccgaaaagaagccatccggttatattatcccctgtcctctctgaatcacttttttgacgtgcaggagagagaagaacaaatgcttcatcgcctgcagcatttgccggaaacctggcaggaaaaacttggggatgtaggtgtgacggcaaaaaaagagcgtttctgtttttatattccggaacagggaagtgtatatgtccatgagcatgaaaagccggatgaatttatccgagaactggtggaactagttggcaggcatggctgtaccatgcaggagatccgggaactgttttgtaaacattcgtcccatgtggaatgtcagaagatcgaaaatggggaattcgactggatgttccggtttgcagaggatgaggaagatccctattattattgttttaaggatgagggaatccatatcatttaccatcgttttttgccggaggattacagggagtttggagtctgatgaaaacagacacagataaggcagcggatcagcagggagaaaattatggcacagacaatattactttttcgtataaaccgggataaatacgcagtgattcagaatgtatgcaggacattaggcatccgtatcatagatgttgcccgcaaggattattcccagaaactgggcactctggcgcagatacagggatttaccagagaagcaaaaaaatatgacggtccggaatttccggcagaaatgctgattttttcggaaatgaattcggatcaggtggatgcatttctggcagaatataaaaaggcgggtgtggaaccaattgcactaaaagctgtaatcacgggcaataatattttctggacggcagagaggacacagaaagaattgttgcgggaacatttatttatgagcaatatttacaaaagcaatatgtgatttgcacaaaaaatttacgttatttttgttgaaaactaccaaagatggtgctataatgtatacaagaaatgagaaaatcatttcgaacatatcagcccatatgacataagataattgagaagggcgcacaccaaaataaaaaaggaggtgtatcgatgatgtatgcaatcgatccaaccatgtcctttgctcaggtagttcagtattacaaggattacgtgaaacggacgaagagctgtggacgcaaaccggtatccttcctgcgatttgtaacaggcagatactaaaatcggatgatccggtggcaaagaagccgccagctcacccgatttttcttttactacggaaataaaacaagataaaaacggcatagctgtgatccagtacatattgcagggatcacaggctatgccgtttgctgtttaaaccgttccggtatccggaattacggctgggccggattctttttcatacaacacattccggttccggatgattcctagcagaatccccaccagaatggaattggcaactgtgccggtaagtccgtaagataagaacggaacagaggcggtataaaacagattgatgccaaagttcgtcagtacatagttgaacagctcaaggagaaggactccgctggcagcagtaccaagcagcattgccagacggttgctctgccgcagcgcacagtgcatgctgtacagcgcaaaaaaggcaagtgcagcgatgattaaaatgccggccgcaatgccgaaccacagaaaaatactgtgcagcagataggtagagtaaagttcttcccgtggaagacggtcactgacagaacttccaccgaacagggaaaaacgtgtctgttcatactgcagggcaagtctcgtaaagccaggtccgtcgtcagtatgctgcagtccgagtgcagtcaacaggcggtcatacagataggtttgcggacgtaaaaacaggctgcctgccaaagctgcgattccgatataaggaagaagtgtccagcaccagagaacctttttggaaccgggcagaatccttttttggatacagattccggacagcaggacggacagaaaaacaaatgccagaaccggcggccatacaaaaccactggtgtggcttaggatcgctccgaaaaacaggagtgacagcacatgcagccagacaatggttttccatcctttttcccggttggagtatagcagcagtgcataggacagtggatacagcagacacagataatagctaaaggtacgggtctgccagaaagagaacgtgcccggaaagaagcaggcgagcagcgcaaatcccaaaaacagaccgtataaaaaccagctgtattttgacaaacacatgtaattgctgaacatcccaaacagaataatgccgaagccaatcatctgatagaaaacggcatgctgcataaacgcggtgttggaataggtggtgttaagtggttcagaaccatacaggatatattgcatgaaaattccggataatgtaagaaacaccgcaatgccgaacaaaacacccggaaaccggggacgatggatccggtttaattccgtgccggctgcaaccgggtctcccatctgccggacagcttctttttctgctgcgtccggagacattcctgtatctatataatcctgcatctgttcgtcaatgtgttcctgaatttcttccagcacatgggtacgtgcatgtgggtttaaaatctgttcgcccagggtctgcagatattctttttcctccatatcagattcctccttcaaaacttaacacattgcttacagcagcctgataggccatccattcctgctttttttcggaagaatgatgccggccggcctctgtcagctggtaatatctgcgttttttcccggaagaggcatcctcataggaccgcacatagcccttgctctccagggagtggagcagtgggtacagggtgccggctttcagttcaaagacgttgttggatttgctgcgaagagcttcaatcatttcgtagccatacatatctttcgtttccaaaaggcgcagaagcagcaatgccatgcttccctgtacgagatttttgtcaatacccatggtatatgacctcctttcagtgataagtactatagactgcctatacatgaaagtatatatcgacagtctatacatgtcaagcaaagggaaaagcgttgtgcaatatgcatgaaaaatagaaaggaaaacttacttatttcacaaaaatgagaataacacttgcgaaactgtgcaaaaaaggtgtatactctgcttactgaaaacgttaccggaaacattgccgtgaacgttttcgaccaggggctgccgtatggacggtaactctacgaacgtatttattttaggagggtgaaaatatgaaaaagaaaattgtatcagcattaatggttgccgcaatggttgtcacagcattcgcaggatgcggaagcgataagggtggcacatccacacagggtggagacaagaccagcaagagttctggaaaggtttacatgttaaactttaaaccagagacagacgaagcttggcaggatctggcagagacctataccgatcagaccggtgtagaggtaaatgtgcttactgcagcagacggacagtacaacacaacattacagtccgagatggcaaagtcagatgcacctaccatcttcaatgtgggaaattcttccgcagcacagacatggaacgattatacatatgatctgaaggactctgagctttacaagcatctgacagataagtctcttgtaatcaactctgatgataaggtagctgccattgcaaactgctatgagtgctacggcctgatctacaacaagacaattctggaaggatactgtggcatggatggtgctgtagtttcttcggtagatgagattaacaactttgatactttaaagaaagttgcagatgacatcaattcccgtattgatgacatcaataaagaacttggaactgacctgacagaggcatttgcttccgcaggactggatgacggatcttcctggagatttgccggacatcttgccaatatgccactgtactatgagttcaaggatgatggatgtgaccttacagccggggaagagtccattaagggaacttatcttgataacttcaaaaacgtatgggatatgtatgtatctgattccgcagcagatcctaagacattaaattccggtgcattaaatgcagagtctgagtttggtatgggagaggcagtcttctaccagaatggtgactgggagttcgctccgttaacagatgaggaaaacggatatgtcgttacagcagatgacttatccatgatgccaatttactttggtgtagatgatgagaatgaaggactttgtgttggtactgagaactactgggcagtgaacgcaaaggcatctcaggaagatattgatgcaacacttgagttcttaaattgggtaatcacttctgacgagggacgtgatgccattacaaatcagatgggacttactgctccatatgatacatttacaggtgattacgagacaaagaatgcatttgcacaggctgcaaacaagttaatgactgacggaaaaacatctgtagcatggagcttcaatgctactccaaacgtagatgactggagagcggatgttgtttctgccctgactgcctataccgcaggtgaaggtgagtgggatgctgtaaagaccgcatttgttgatggatgggcaaatcagtggaagatcgcccatgaagatgatgcacagtaatcaaagatgatgggaaaaggggtaagtggcatgccgcttactccttttttaaaagaagcacctgcagtgcaggctggtactggcaggggctgcagttagtgaaaggaatgtattatggaaaaagcaattaaaaaatatttcccgatttttctgcttccgacaatgattgcgtttgcaattggatttattgtaccgtttgtatatggaattttcttatctttttgtaagttcacaaccgttacagactggaaatggaaagggttacagaattattcgagaatcttttttgtaaacggaaagttagacacaacatttattcattcattatggtatacagcgttatttacggttgtatcggtgctgatcatcaatgtgatttcatttctcattgcgatggcacttaccaaaggcatcaggggtaccaatcttttccgtaccgtatttttcctgcccaacctgattggtggtatcgtactcagttatatctggttaatgatttttaacagcgtattatccaatttctccaagacaatcgtatccacacagtggtatgcgttctggggtatgattattgtagtatgctggcagcagatcggatatatgatgattatctatattgcaggaatccagaatattccgggagaattaatcgaggcggcaaagattgatggtgcaaattcctggcagctgcttcggtatgtaacacttccgatgctgatgccgacgatcaccatttgtacattcctgacgctgaccaatggatttaagttatttgatcagaacttcgctctgaccggtggtaatccggctaagatgtcacagcttctggcattaaatatttatgacacaatgtacggcacgaccggatggcagggcgttggtcaggccaaagcggttatcttctttattctggttgcagttattgcgctgattcagaataaactgaccacaagcaaggaggtgcaggactaatggctaaaaagaataacaatcaggtaagtgctgtccgtcaggcaaaacatggctggatctggacactggcatttacggttatcagcattttatggattgcacccattctggtagtccttttaaattcctttaaaagaaaagcctttattttcagacatccgtttacacttggaacagagccgctttccgctggctgggataaatttattcatggtgttgaacgtgcattctgtggctggctgaactattccaacggtatccgtaagacaaatttctggaacagttttgggatttccctgtttattacagtagggtcggttgcattgattattatctgctgctccatgtgtgcatggtatattaccagagtccatacaaaagtgacgaaaacaatttatgtactgtgtctgttttccatgattgttccattccagatggtaatgtttacgttatcaaaatttgcaaaccttttacatctgtccaatcctcttggaattattgttgtatatctgggatttggagcggggctggccgttttcatgtttaccggctttgtaaagggaatttccctggaaattgaagaagctgcaatgattgatggatgtacaccattacagaccttttttaaggtggtttttccaattttaaagccaacgacggtaacggtagcaatccttgaggcaatgtgggtatggaatgattaccttctgccgagtctggtgttgaatgttaataagtataaaaccattccgatcgcaatccagtttctgaaacagagtcatggacagatcgactggggtgccatgatggcggtacttgttcttgcaattctgccaattattatcttttatattgcgtgccagaaatatataatagaaggagttcttgcaggtgctgtcaagggctagaaaatagacatttcgtctgtatatacgaggtgaaggaatgacaattgtagatattgcgaaagaggcaggatattctgtcagtacggtttcccgtgtcctgaatggaagaagagatgtcagcgaagaagcccgtgaccgcattatgcgaattgtggaagcttaccagtttgtaccaaataacaatgccaagcatttaaaacagaccgtgagccagagtattctgattctcgtaaaaggtacttcgaatatgctgtttacaaatatcatagaggtaattcaggatactatcgagggatcggattattctctgcgggtgcattatctggatgaagatgcagatgaagtgaaagaggctgtgcggatgtgcagggaacataagccaatggggattttgttccttggaggtaatatacagtactttcatgaagaatttgaactggtcaatgttccgtgtgtgctggtgacagatcgggcggataaactgggatttcggaatcttgcatcagtttcaacagatgatatggcagctgcggagatggcggttgattatctgtttgatcacggacatcgcgatattgctgttatcgggggagatatggcattatcttccccaagtaaataccgtaaagcaggagcgaagcgcagctttataaaacatggctgtgaatttgaggaagaaagttatgcggtagcgcggttctcatatgagagtgcatacaatgccatgaaccggatgctggcttccaaaagatccattacagcggtttttgccatgagtgatgtgatggcagttggtgccatgcgcgcaatttttgatgcgggtctgcgggtaccggaggatatctcggtgatcggatttgacggaacacttcttgcagattattataatccaaagattgtgacggtttgtcaggggtatgaaaagattgccagaaaaagtattgatctgttgtttggcatgattgatctcaacaaaccggccacacatgaactggttccatttagtttaaaaaacacagagagcgtaagctctatttgatttctgcttatttttaagaagccgtgcggcattgctgcacggctttaattgatggagggacggagcagccggtagatggctgctgcaagtggcacggcaaacaggattccccagataccgaatgccccaccgccgacaatgactgcggcaagtacccagatgccgggcagcccgatggaatgtccgaccacacggggatagataaaattgccttcgatctgctggagaattgttaaaaagataagaaataccagtgcttttaccggggaaaccgtaagaagcatacacgcaccggctgcggcaccgatataagctccgatgaccggtagcagcgcggttacacctaccagacaaccgatcatggcagcataggggagacgcagaatccacatgccgatggtacaaagcataccgaggattacggcctctatggtctgccctgccagaaaatgatggaaggactgattgagaaccgtcagtacgtaacgtatttttttcccttggaaaacaccgaaacaccggtcgatcagggaactgcccatccgtaagagggattctttggcagcaagcagataaaaagaaaacatcagtcccggcagaaaaattaaaagccagctgccaagtttctccagggaagttttcatgccttttgccagacgggggatttttgcaatcagtgtatcccagcaaaagggttcattcatccatgcccggatttcgtttcccatgccaagatccatttgcagatgttcgtttgcccactcacacagtaattctaaaacctgggggaaatcggttgcgatgatccggatgcaggataacagctgagggacgatcatccaccataagatcaggatcacaagcacaagcgaaaagtaggagagtgtcatacataggggacgttgtaagggcgcaatggctgccatacggcatattcttgcatatcctttttcgtaaaaacacataaggatattaactacataggcaatcatacagccgatcagtaagggaaggactgcgcggaaaacagtttttgcaattactgccagaatgggcaatacataaaatagtgaaccatacatagggcatactccttttcctctacaaatatttattagtttgggcagaagaaagcgggattatgtaaaaataaggaaatgttaaggtagaatcatggtttcgccccttgaaatcatggagaaagaaagctagaatacaaaacagatgatagaatcaaaaagtattgcttatttaaagaagggattcgatgatgaaaaaaggactggtcatggaaggcggagccatgcgcggaatgttcaccgccggagtcatcgacgtgatgatggagcatcagataacatttgacggagcgatgggcgtgtcagcaggggcagtgtttggctgtaattataagtccggtcagccgggacgcgtcattcgttacaatgcagcgtactgtaataaaccgcagtatgcgggactgcgcacatttttgaaaacaggggatatgttcggggaacagttctgttatcatgatatcccggagcatcttgacccgtttgattatgaggcttaccgcaagaatccgatggatttttacgtggtggtgacagatgccaaaaccgggaaagctctttacaaaaaagtggatcggtgtgataagacagaaatggaatggatgagagcatcggcatccatgccgattgtgtcaaagccggtctgtgtagacggatatgaattgcttgatggaggcgtagcagattctattccggtgcagaaaatgcaggaacttgggtttgataaaacggtagtggttctgacgcagccgcgggattatgtgaaaaaaaagaatcagctgatgccgctggcgaaagtatcgcttcgcaggtatccggcgatgattgatgccatggaacaccggcatgagcattacaacgaagaactggaatatatcagggaaaaagaagaacgtggggaattgtttgtcattcgtccgcccaaaaagatagaagtcagcaaagtagaaagagaccggcagagactccttgccgcctaccgcatgggacgggagacgatgaaggagcatatgcgcagtctcgagcggttcctgaaataagcacctgttacaggaatcggtaaatcaggatcgccagcacaattccgatgatgccggcgatcgttatttttatggttaatccaaatgtgagcaccaaaattcccagatcaagtaccagtgggttggaaagaccaaaggtctgtccgtaattcagccagcggagagccggaacaccggcactaagctgaccgataaagccacccagtacaacacctgcgagaatcatcaaaagaagtgcccaatagttttttccagcagttccttttgccataaaatatcctcttttctaaagtctagactcctatcatatcataaaaagtgaaaaatcacaaaggatacatgttttttgtatagaacagcattgaagcctttggttttttgtgataaattaaacatatcggcatgaattggtatatgggggaggacaattgaaaaaaatagcattgatatcagacggctggcgccggatgatcacgtatgcctgggtagatgggatcatccggcggatcagggaactggatgaggatattgctttgtatcagtacaattgttatggcaattggagcaaagatgcattgcataatacgggtgaatataatatttataatctgccggatctgtcagcgtttgatggaattatactggatggaagcaatattgtggatgtccggcaaaaagaaaagattgtagaacgcctgcagaactgtggggttccggttctttccctggactggtatatcagcggattttattatgtaggcgcagataaccggcgtccgatccgtgaacttatgacacatttatacgaagtgcatggatgccgcagatttgtttttgccggaggcccggaagatgctttcggaaattttgaacgtgttgctgcgtactgcgaatgcctgaaaaaatatggaatgacattggatgacaatccgattttatgtggggattacgactatgagaccggcgtgaactatatgcgggagtatgtccatagcggctcgaaacttccggatgtgtttgtctgtgcaaatgacaatattgcggcaggaatctgtgcagaggcagaacagtgggggtaccgcgtaccggacgattttctggtgacgggctttgataatctggataaggcagcctatttccgtccgcagattacgactgtatttcaggaccgggaggagatcggaaagctttgtgtggatgtactgctccgtatctgggaaggaaaaccggtggaagaacgcaactatattccggttacctgtatttacggagaaagctgtggctgtccgaataacggcatggtaaactaccgcgaatatataaaggaaaagattgttgcaacggtcaaaaaagatgaagatgattcccttctcgtggaattggaagcgcagatggcaaggtgcaatggtttccgggaaatttttgaatatattgttgactatttccagaaactgagatgtgacggggtatattttgtggtggatcgcaagctgtttgcggccgatgaggatacggattttccggtggaaggctatgatgaaaagaatcttgtggtggcagatggatttgagaaccataagagaatggcatttgccagtgtcggggaactgaaccgccatctggaagaaacaggaagccagaatgcctatctgtttaccccgattcatttccgggaacagtcggttggctatctggtaatgaaaaacggacgatttctgtatgataatccatattattatgacattcacagcacgattgtaaagacactggaaacgcagtttaagcaaaaacagctggagaatgccgtaaataaacttcagatgttgtacaaccgggacccgctgaccggtatctgtaaccggattgcgtatacggacattatccgtccggcatttgcaaagtatcaggaaaagggaatagcatgtgcgtttgtctttgtggatgcggatgattttaaatctgtgaatgacacatatggacatgaatttggagatcaggtactgataagaattgcacaggttcttgaggaagaatgcccggaacagggatatgtatgcagatacggaggcgatgagttcatcggatttttcccatatgcgacttccaaaaaggcacaacagtacacggatcgtgtgcagagccggctgaccaaggaaaacattatgatcagtatcggtgtagagctgacgtttgcggggggagaagagactatagatgagtatctgtcacttgccgatcagaatatgtaccgccagaaacaaatgcgcaaagaaagcaggaaaaatatagagtgataatagattgacaaatttatcttaccaatgtatagtaacttagtaggaatactaagttttaaatgctgtacatttttttaagaaagaagagatatattatcatgaagatttcaacaaaaggcagatatgccatgagactgatgctggatctggcattgaacaacacaggagcgccgatcagtttaaaagatgttgcaagacgtcaggagatttccgacaaatatctggagcagattatttccgtattgaaccgcgccggttatgtgcgcagtgtgcgtggagcacaggggggatatctgttgcgtaaagcaccggaggagtataccgttggaatgattctccgcctgaccgagggatcgctggcaccggttgcatgtctcgatgagggagacgatgtcaactgtgagaaacgggaagactgtgttaccctgattctctggaaaaagattaatgatgccatctgcagtgttgtggatcatatcacattgcaggatctggttgactggcagagagaaaaaaatggggattatgtgatatgaggtatctcgaagagacatctcatgcgatgtgctccttattaaaaaagaaaagaaagtaggaagagtatgagtaaattaatctatctggacaatgcggctaccacacaggtatacccggaagttcttgatgcgatgctcccgtattttacggagcattacggtaatccggcagctatttacagctttgcaggagagtcggagcgtgcggtcgcaaaagcaagaaagcagattgcagatgtgatcggggcaaagaccgaggaaatttatttcaccggaggcggaagcgagtccgataactgggcactcaaagcaaccgcagaggcatacagcagcaagggaaagcacattatcacatccgcgatcgagcaccatgcgatcctgcacacagcacagtggctggaattgcaaggatttgaagtgacttatgtcggtgtggatgaaaatggtaagattaagctggacgagcttgaggcagccattcgtccggatacaattctcatctctgtcatggcagcaaacaacgagatcggaaccatcgagccactgaaggaaatcggtgcgattgcaaagaaacacggggtactgttccataccgatgcggtacaggcatttgcacatgtgccgatcaacgtggatgagatgaatatcgacatgctcagtgccagcggtcacaagatcaacggaccaaagggaatcggagtcatgtatatccgcaaaggcgtaaagatccgttctttcattcacggaggtgcacaggaacgtcagcgccgtgccggaacacacaatgttccgggtatcgttggaattggaaaagcagcggaacttgcagttgccaatatggaaaagaacacggagtatgaagtaaaactgcgtgatcatctgatcgaacgtgtgcttgcagagatcccgtacacccgcttaaacggagaccgtaccgaccgtcttccaaataatgcaaacttctgtttccggtttatcgagggagaatccatgctgatccttctcgatcaggcgggcatttgtggcagcagcggaagcgcctgcacatccggatcattagatccgtcacacgtgcttttagcaatcggactgccacacgagattgcacacggaagtcttcgtctgacactttccgagaagacaaccatggaagagattgattatacagtagacaaattgaaggcaattatcgaacgtctgcgcagcatgtctcctctttacgaggatttcgtgcgcaaaaacaaggaggagtagtatgtacagcgaaaaggtaatggaccattttaataacccgagaaacgtaggagagatcgagaacccgagcggtgtcggtaccgttggcaacgcaaagtgtggagatatcatgcgcatgtatcttgatattgatgacaacggtattattcaggaagccaaattcaagacattcggctgtggtgcagcagttgcaaccagcagtatggcaactgaactggtaaagggcaagaccattcaggaagcccttcaggtaaccaacaaggcagttatggaagcactcgacggacttccaccagtgaaagtccactgttccctgcttgcagaggaagcgattcatgctgctttatgggattacgcagagaagcacaatatcaggatcgagggattagagcgcccggtcaacgatattagtgagaaggaagaggctccggaagaggagtattaaatgaaagaaaaagtagttgtaggcatgtccggaggtgtggattcctccgtggcagcctatcttttaaaggaacagggatacgatgtgatcggtgtcaccatgcagatctggcaggatcaggatgtctttgtgcagtcacaggagggcggctgctgcggactttccgcggtagatgatgcccgccgtgtggcagaacgtctggagattccgtattatgtgatgaatttcagggaggatttccagaagtatgtcatcgactatttcgtgtccgaatacgaaaaggcacgcacgcccaatccgtgcattgcctgcaaccgctacgtcaagtgggaatccctgctgcaccgttcgttagagatcggtgcagattacattgccaccgggcactatgcgcgtatcatgcagcttccaaacgggcgttacacgatccgtaattctgtcacagcggcaaaggatcagacctatgcactttacaatctgacgcaggagcagctttcccatacgcttatgccggtgggcgattacgataagccacatatccgccagattgcagaggagatcggacttccggttgccacaaagcatgacagtcaggatatctgttttgtgccggatcacgattacgcctcctttattgcacaggaaaccggaaaagagagtatgccgggcaattttgtggacgaggaaggaaacgttatggggcagcaccgtggactgattcactacacgatcggccagcgcaaaggactgggcatttcttcaacaaccccgatctttgtcagggaacttcgcccggagacgaatgaagttgtgctctgcaaatccgagagtctgttttcccacgattgccatgtggacaacatcaattatatggcggaggaaaaactgacagagccggtcagggcaatcggtaaaattcgttattcccatgcgggggcaccgtgtacgctgtatccgcagccggacggtaccttgctggcgcagtttgacgaaccgcagcgtgccatgacaccgggacaggcggcagtgttctatcaggatgatcatgtgctgtgcggtgggacaatagaaaaagaatagcatataacaataagtctggatttcagaagtagtgaatccgaaacagtaataatagaataccaggaattgtgagtgtgcgaagcacaggacagttcctggtatttgtggtttaaacgtcatgattatatatataaggttttgacaatttccgaaaaatcaatatataagtctttataaatattgaccttgatcacggagtcaaatgtatacgggacattcaacaggtcattttcgaaataattcacagtgacagtttttctctgtgggtcaacaatccagtattcccggactccataatttttatagtaatagagtttgcggatatagtcatccgatggattccccggagatacaatttcgatgatgaaatcgggagcaccattgcagcgttttccatcgagtttatccctgtcgcatacaatcatcagatccggctgtacaatcgtaagcggagaatcatttagtttcacatcaaaaggagcaggaaataccgaacagctcccattgttttttcttatataattacgtagggaaacgagcagttccgtcaggatcgactggtgaagctgagaagggcttgccatattataagcaattccgtcaaatacttccatacgttgttcttccggcatggattcgtattgtctgagatccataagttcctgcgagtattgtattgctggcataaaaactcctttcttctgtatagcatagggaaactaattaattagtttccctgtttatgttttatcatacgggaaaaaagagggaaagtcaaaaaaaatttgttcttccgaaagaaatgtctccttcttccgtcgcatcgaaaaaacttatatttagaacaatccacgcaaatccgtccctctgaaaaacaaaagatcccagaccacacagttaaacagcaatttgtattggaagaaaaacatgatttttcacattcccctatttacatagtaggggagtggggcttataatcacaccgtagaactcacggaatacgctgcggtcgtatttcatgaaatgaggtggtaaaacgatatgatgatatccgcaaaaagcagatatgcactgcgtgtgatggtcgatcttgcgcagcacaattccggagaattcattccggtcaaagaaattgccacaaggcagggcatttccctgaaatatcttgaaagtattatgaccatactgacaaaagggaagatgcttgagagtgccagcggaaagggtggcggttaccgtctgatcaaacaaccgtcggaatataaagtaattgagatccttcaactgatcgaaggaaatttagctccggtcgcgtgcctgtgtgaaggtgggaaaaagtgcgagagcaccgcagagtgtaccacacttccgttctggcagggactggaagctgtgatcaatgattaccttgagaagcatacccttgaggatatgatttcacagaagacgcattcctgtgaaagttaaacaacatgttttatatggaggaaatacaaatgtctgaaaaaaatttattagagatcaaagatctgcacgtaaacgttgaagataaagaaatattacacggagtaaatttagaagttggaaaagatgaagtgcatgttctgatgggaccgaacggaaccggaaaatccaccctgggctatgccatcaccgggcatccgaaatatgccatcacatccggacagattttctttgacggagaggacatcacagagatgccggtgaatgagcgtgccaaaaagggaatcttcctctccttccagaatccgctggaagttccgggggtgacattgagcgcatttatccgtaatgcactcgagcagaagaccggaaagcgtgtccgtctgtgggatttcaagaaaaaactgaccgagaccatgaaacttctttccatggacgagtcctatgcagaacgtgatttaaatgtcggcttctccggtggtgaaaagaaaaaagcagaaattctgcagatgcttatgttagagccaaagcttgcaatccttgacgagaccgactccggactggatgtggatgctgtccgtaccgtatccaaaggaatccagctttacaaagaaaaatgcaagggaagccttctgattatcacccatagcacacgaatcttagagtcattgcatgtggatgtcacccacgttatggatgaaggaaaagttgtgaaaaacggagatgcttccttagtagatgagatcaacgaaaacggttttgaggaatttgaacagtaagaaaggtgcgtgcgaaatgagagaaaagagtcaggtagaagatatcgaccgcagcatctatgatatccgcgatgaggaaaaagatgcatacagaatgaaagaaggtctgaccccacagatcgtggagcagctttccaaagaaaagggcgatccggcatggatgcagcagttccgcctggagtccttacagatttacaatgagatgccggttccggactggggaccgtcaattgagggactggacatggatcacattgccacctatgtccgtccacattccaaaatgcaggcatcctggaaggatgtgccggaagacatcaaagagacatttgagcgtctgggaatcccgcaggccgagcggaaatccttagccggtgtcggtgcccagtacgattccgagctggtatatcacaatgtcaaagacgaggttgccgcacagggcgttgtctacaccgatatggaaagtgccttaaaaggagaatatgcggacatggtacacaagtatttcatgaaacttgtcaccccgcatgaccataagtttgcagcactgcacggagccgtatggtccggtggttcgttcgtctatgtgccaaagggcgtgcacgtgtccattccgctgcagtcttatttccggttgaatgccaaaggagccggtcagtttgagcatacactgatcatcgtggacgagggcgcgagccttcatttcatcgagggatgttccgctccgaaatataacgtagcaaacctgcatgcaggctgcgtggagctgttcgtcaaaaaaaatgcaaagcttcgttattccaccatcgagaactggtccaagaatatgtacaacctgaataccaagcgtgcctccgttgaggaaggcggaacgatcgagtgggtttccggatcgtttggctcccatgtgggctgcctgtatccgatgagcgttttaaagggggagggtgccaaaatggaattcactggtgtcacatttgccggacacggacagaatctggataccggtgccaaagtggtacacgcagcaccaaacaccagctcctatatgaatacccgttccatcagcaaagacggcggaatcagtaccttccgaagcagcgtggttgtggcaaaggatgccaaaggatcaaaatcagcagtatcctgtcagtccctgatgcttgattccgagtcgcgttcggatacgattccggccatggacatccgtaccaaagacgcagccgtgggacatgaggcaaagatcggaagcatcagcgacgatgccgtcttttatctgatgtcacgaggcatgacggaagaagatgcccgggcacttttggtcagcggatttgcagacaacgtatccaaggaacttccggtcgagtacgcggttgagatgaacaacctgatccggctggagatgaagggaagcataggttaggaggagaacaatgacagaaatgacaatcaataaacttccatcgaagacctggtattggttacatgtcaacgagaccaagcttccgtgggacaaagaacatacaacagaacttccggaggaaaccgtgacagcgggaagcaccgaagaggtacgcttttccattaccggagagggaagatacagcagcaaaaagatccatatcatagcaccggccggtaagcaggtgaccgtgtttatggattatcagacagaggaaaaacttgccgtaaggacaagcctttcggtggaagaacatgcacgggtgcgtctggtgcagctgcagcacacagcagaaaattcccttgtgtacaatcagattgagggagaatgtgcaaaaaatgcccgtatcgagctggtacagatttatctcggaaaaggagatatctattccgatacgaccatcaacttaaacggtgatgcaagcacctttaggagtgatatcggctatatcgggcagcacacacatatcatcgacatgaatgaagtggtcaaccactatggaaaacatacagagagtgaaatcaatgtgggaggtgccctgcgcgacggtgcaaagaagatcttccgtggaacgattgattttaagaccggctcttccgattctgtcggaaacgagctggaaaatgtactaatgcttggcgatgatgtggagaataaaactgttccggtgatcttatgctccgaggaaaatgtcgttggtaatcacggtgcaacgattggggaacttgatgaggataccatgttttattttgccagccgcggaatcgacaaagagcacgcggaaaatattatggcaagagcaaacattgaccgcctgaaaggaatcatcaaagacgacagctttgccagaatgattgacgaagaacttggggaggtgtagcatgaccgattatcgcaaggactttccactgctgtcagaaatcggggaaaatacagtcgatggcagggaatggatctatatcgacaatgcggcaacttcccagcgtccacagtgtgtcattgatgcagaacgcgatttttacctgaaacacaatgcaaatccgctgcgtggaaattatccgctgagtgtggaagcaaccgaactgtatgaaaatgccagaaaaggcgtgcgtgattttatcggagccaaatccgcgcgtgagatcatctttaccagaaataccacagagagcatgaatcttgtggcatacagctatggtttaaacaatgtaaatgccggggatgaaatcctcgtttcgatcatggaacatcacagcaatcttctgccatggcagatggttgcgcggcagacaggagcggtactccggtttatcgaatgccgtacggacggatcggtggatcttgatcaggtaaaagaacagattacggaaaagacaaaaatcgtagcaatcacacaggtttctaacgtgctcggacgtgtgaacccggtcaaagagatcgcagccatggcacatgaaaaaaatgccattatcgtggtggacggggcacagagcaccccgcatatgccggtcaatgtgcaggatctggatgcagacttctttgcattttccggacataaaattttcggaccgatgggaattggtgtgttatatggaaagaaaaaactgttaaagaaaatgccgccgtttctttccggtggcgagatgatcgaatccgtgacccgcgagagcgcaaaatacgcagaacttccgcataagttcgaggcgggaaccgtaaatgctgccggtgccatagcactgcatgctgccataaaatatgcacagtctgttggctttgacgtgatgcaggagcgggaacttgccgtgacaaagcgtgcgtttgacggattaaaagaacttccacatgtgcatgtacttggatccgaccgggccgaagaacacaccggaattcttacatttacaattgatgacgtgcatccacacgatgtgagcgagattttaatcgccgatggcatctgtgtgcgtgccggacatcactgtgcgcagccgctgcttaattatctgggcatcagctccgccaccagggcaagctttatgttttacaataccgaagaagaagccgacaaatttgtagcaggcatcgcaagtataagggagcgaatgggatatggaaaatagaagtttttataatgaaatcttaaccgagcacaacgtgcgcccggagtttaaacatgatctgccggatgcggatattgtgcttgagggtgtcaacccgagctgtggggatgatattttcctgaaattaaagacggatggcgacacgattaccgatggtgcatttgtcggggacggatgtgcgatttcccaggcttccgcagatatcatgcttggcatgattgtcggaaagaaaaaagaagaggccctgcagatggggaaaatctttatgaaaatgatcaaaggcgatgccagcgaggaggagattgattctcttgaggaggcatcggcactccgcgatatcgcccatatgccggcgcgtgtgaagtgtgcagtccttggctggagaactttaaaagaggctttgctcggtgaggatgcggacgatgatgacgatgaggatgacgagtaataaagtcggagggtttttcatacacatatagataaaaatacacgatgcttcttatagaatacgttacgaattttgtgcagtttctggctctgttaaaattttggagtcttaattgtggcaaagcggagtaaaatataaggagtgtcgtgtatttttttaggggtataaaataatatcgtaaaaagtagttgacagcgtttgggaaagggtgtatattcataacaacagataattcctactaaagaagtatgaaaataagggattgaatcagagagagtaaattggaggataataaaatggcaaatatttatgaaggaacattggaactgatcggacacacaccactggtagagttcaaacacatcgagaagaagtttggccttgaggcaagacttcttgcaaagctggagtactttaacccggcaggatctgttaaggaccgtattgcaaaagagatgattgagcaggcagagaaggacggaaaattaaaaccgggttccaccattatcgagccgacatccggaaatacaggtatcggacttgcggcaatcgcagcagcaaagggataccgcctgatcatcgttcttccggagaccatgagtattgagcgtcgcaacatcatcaaggcatatggtgcagaacttgttctttccgatggaagcaagggtatgaagggagccatcgcaaaggcagaggaacttcacaaagagatcgcagacagcttcattccggagcagtttgagaaccctgcaaaccctgcagcacacaagaagacaaccggaccggagatctgggaagataccgacggaaaagtggatgcattcgtagccggtgtcggtacaggcggaaccatcacaggtgttggtgagtatttaaaatcccagaacccggatgtaaagatcgttgccgtagagccagagacatctgcagtattgtctaccggaaaggcaggtccacataagatccagggtatcggagccggatttattccaaacacactcgataccaaggtttatgatgaagtaatcccggtttccaatgaagactctttcgagtattccaaatatattgcaaaagaggaaggtgtgctggtaggtatttcttccggagctgcattaaaggcagccatcgaagtggcaaaaagaccggagtttaagggaaagactgtagttgcccttcttccggacagcggagaccgttattattctactgatctgttcaaggattaagataaaattcggaaaaagttcagactttatttattccgttttgcggatgaatccattataataaaggcatgtggaaaccagaaaggaaagtccatgtgcggagagcttcatggaaatttatttccgtgaagttctttttatttaaaacaattgggaaagtttgtgctccgcttaggcagactagaaattctgagcgcatccttggcagacggacacaagccgcgccgctgtcgaaacgttgcccggacacaaaattagagccacgcaatcactttcgcaaattctaagattctgtctaattcgtgcgtatcggagaggccgcagccggagccaccacacgggagtccgccggaactaaggatttcacaattatttatatagaaaattacaggagaaaaagaggaaatagatatgaacgaattaagtaaagtagtaaatgcgcagctgcagcaggcagcggaaaaccttgtccgtaaccgtctgatgtctgatgaatttttggattttgtgcaggaaaatacaaaaccgctggatacgctgatggcatattacaagtgcgcaatcatggaagtagaaacgaagtttaaagtgttaaacgaacaattttcgctggaatatgaccgtaatccgatcgagtccatcaagacgcgtgtgaaatcgctggacggaatcgtgcgcaaagtgcgccggaaaaatattccgttgacgctttcggcgattgaacagaacatcaatgatatagcaggaatccgggttgtgtgctctttcccggaagatatctatctgttggcggactgcctgcttcagcaggatgatatccgtctgatcgaacagaaagattatatcaagcatccgaaggaaaacggataccgcagcctgcatctgatcgttgcagtaccgatttttctgcagaatgagaaacgggaaatgaaagttgaagtacagcttcgcaccattgccatggatttctgggcgagtctggagcacaaagtgcggtacaaaaagaatgttccggcagatgaaaccgagcgtctggcacaggaactgagcgaatgtgcacagatcagtgcagatctggaccagcggatgcagaatatccgtacccgcctggcagatgcggaattacagcatccacagaaacaaaagaaagatgaacagatccttctggatgtgctgggactgtaatgccgctggtgctcacaggtaagcatgagaacggtaacttctttatgcactgtgctcccatggacgtactttcagatggacaccgcggctgtcggcgatgcgctgacacgccttaatgtcttcttccggaagaatatccacgatcgacagctgcgtgtgtgggataagttttccacattcctctgcaaaatcaagcattgcctcataagcatgagggaaggatggacgggttactttttcgtacttttctgcagttgcctcattcaagctgatggagatgctgtctacgacctctgctaattccggcacaatgtcacgtttataatacaggtttcccagaccattggaattgacacggatcgggagacctgttttttctttgacatatctggcactggcgatcagattctccagtgcacaggtcggttccccatagccacagaaaacaaattctttgtagccggtgaaatcaaaggcatcaattgcggcaataatctcacttaaagaaggctctgctttgtgccagagggtatccgcatcacccacaccatcaaactgtttacggatacagaacgtacagttgcagtcacatttatttgtgatatttgcatatacctgatcattgtacacatataaaatttttgccataataattccttctttctatcgtatggattaatcaattgagaaattcttttccgggtttttcgtttttacacgtttgaatctgcaatcaggtcaataagaaatttctcgaaattaacgccatcgcgtcccggcgtattttctttcatggtatccccgatactgtgggataaaaatttcccggcaagcagaatcgcatcttctgtgcatatgccctttgtgcggcagccacacaatacagaggcaaacagatccccggttccggaaaaactccggtcaaaaaacggcgattcgtgccggtaaattccatttgcagtggcagcaatattataaatgacgggatgtttctcatcacggcatttgacaccggtgatcacgacatcctgtgggtgtgaggcttttttttgcagccgcagtgccacatcttctgccagcttcagcagatccgtgttcgtccggcagtggagtaaggcatcttccgggatgtctgccagcagacaggcttccgtcagattcggtgtgatcacgtctgcttcaagcgtcagttctttcattccatttaacagccccggagtaaaaaacggataagcatttccgtcatcccccataacagggtcaaccagaagaagcgtatgttcttcccgaaaatagcggatgaaatcaagcacctgcgaaatctgttccgatccggtcagaaatccgctgtagatggcatcaaaatgtgcgttatttttcccccaggcatcgatatagtccggtaacatggcggtcagatcggtacagtgataacagggataaccggtctggccggtcagtacggctgttgcaaccggacaacactgcacgcccagcgcggataataccggaatcgctgccgtgagcgaacactttccgaaaccggacagatcatggataacagctgcttttttcatggaaaacctccgaattggtgaaaatagttctttgtatcttagtatagtgcgatctatcggtgtgtatatatccaaaatgggaaaaaaatataaatccagtctgcaaaaaatcatgtacaactatttgtgttttgatgaaaataacggaaaaagcaaggttacactggacaaatatggtaaaaagtaataaaattatgagcatataggggtggggtttatacaaaaatcataataaggagtgcgtttatggaactgatttacacaaatgatttatgcaccggatgcaacaaatgcgtgcggggctgtcctgtacttacggcaaatattgcaatacaggaaggttatgtaacggtagacccggacaaatgtattgcatgtggggaatgctttgatgtctgcccacatgaagcgagagactattatgatgatacggaccgcttctttgaagaccttgcatcgggaaagaaaatttccgtgatactggcaccggcatttctggcaaattattccaaagaataccagcgtgtgctgggctatttaaagagtaagggagtcaaccatatctgcagtgtatcgttcggtgcggatatcacaacctggggatatctgaaatacattacggaacacaaatttttcgggggcatttcccagccgtgtccggcagtagtcacctatgtggaaaaatatataccggagctgatcccgcgtctgatgccggtacacagtccgatgatgtgtactgctatttatatgaaaaaatacatgcaggtcacagatgaaatcgcttttatcagtccgtgtattgccaaaaaattagagattaccgatcccaattgcggcggatatgtttcttataatgtaacttttgaaaagatgatgaagtatatcggaaacgattatgaaggatgtgaaccatataccgatgaactggaatacggactgggttctttgtatccgatgcctggtggactgcgggagaatgtagaacattttcttgggaaagagcaggtagtgcgtcaggtagagggcgagcatgaggcctatgaatatctgcgttcctatgcacagcgcattcagcagaacaaagaacttccatttatggtagacattttaaactgtgcgaagggctgtctctacggaactgccacagatccgaaacggggaacggatgatgtcatgctgacaatcgcaaaactgcggaacagcaaaaccagtgcaaaacaggagaaggcacactttggcaggaagagcaaaagcaggagtccgtgggcagatacactgacaccggaggaacgtctgaaaaacttcatggacgcttttggaaagctggacatcaacgattttatgcgcagctacaccaatcgcgcagtacatattgaggaaccgtccgaacaggagaagaaccgcctgtttgcagaaatgaaaaaagatacctatgaggaacagcacagggactgcgaatcctgtggatattcaagctgcaccaacatggtacgtgccatccacaatggagtcaacgtaaaagaaaactgtgtgcactatgtgcggggcatggcagaggaagagacaaaaaagattgcagaacttcgtaatcaggagcggacggaacaggaaatccgccagcagaagattacagatatcacagaccgatttattaccctgagtgataacattgcagaactgaatacggcaaacgaggaatctgcaaatgaagcaaccaatctggcacagtatattcaggatatttcccgtctgtgcgatgaactgaatgagtccatccgtatcatgtcggatttcatcagtgtatataaaaagagcaatgaagatatttctgccattgcgggacagacaaatctgctttcgctcaatgcctccattgaggcggcgcgtgccggtgagaacggaagaggctttgcagtggtagcggaggaaatccgtacactgtctgattccacgaaggatcttctgacacagaacgaccagaaagccgaggcaattctcccaaagattacacagagcatggattcgatcaaagatctggtagaaagcatgaataccatgacgcagaaagtgtcaacgattgccgcaaacacggaagaaatttcttcccagacgacctatgtacagaatatgacagaagaaatgcgggatgaggtgaaggaactgtagatgaaagaggatgcgtattacacatccggacaatttgcaaaaaaagcacatgtgacacttcgcgcgatccggtattatgataaacagaatattttaaagccaagtgcacggactgccgcaggagcgcggctgtatacggatgcagatctggcaaaactccagcagatccttttattaaaatatctgggattttcgctggaagatatccgggagatgacactagctgcggcagaccagcagtatcttcttgaatccatgcggatacagaagaagctgctgcggcagaaaatggacgaaatgcaggcaatggatgaggcgattgaccgcaccatagaggtcatccagacggaacaggcgattgactggaacagtatgctggatctgatccatctgacggcagtggaacgaagcctgaaaaaccagtaccagaatgcggcaaatatttccgcccggattcgcctgcacagggagtattccgtcaatccgcaggggtggtttccgtggattatgcagcagtgtaatctgcagccggggatgcggattctggagctcggctgtggaaatggagcactctggaccgaaaacagggaacaactgcctgcggatctttgggtcgttctctcggacaaatcggaaggaatgctaaaggatgcacagcgtgcactgggagaggacagccgcttttcctataaaaaatttgactgcgaagaaattccttatgaggagggaatgtttgatgttgtggtcgcagatcatgtgctgttttactgtgaaaatatcccgcaggtgcttgcggaatgtcggagagtcttaaaaaatgggggacggtttctatgcagtacctacggaaagcagcatatgcgggaaattaccgatctggtgcagcagtttcataaagaaatcgttttgtcagcggaggtgctgtatgagcggttcggacttgaaaacggagaaaacctgttagcaccgtattttccggaaattcagatgcgaagatacgaggatgcgattgaaatagcggaagcagaaccgctgatttcttatattctttcctgtcacggaaatcagaaccagttgcttttgaaccagtacaaagagttccgggaatttgtttctgcccgtgtggcagatggatttcatatcacaaaagatgcagggatcttcctgtgcagaaaatagttacgaaaaatctataaaaaagacttgaaggtgacctagcgtcaccttttataatgcaatcaaatagaaaaattggaaactcacacaggaggaaaagtacatgactattattgtaacgggtggtgccggtttcatcggcagcaactttatcttctatatgttaaaagaacatccacaggatcgcatcgtatgtctggattccctgacctatgcgggcaatttgtccacgctcgcaccggtgatggagcagccaaattttcgttttgtcaaattggatatctgcgatcgaccgggcgtatacaaactttttgaggaagaaaaaccggatgtcatcgtcaatttcgcggcagagtcccatgtggatcgttccatcgagaatccggaagtctttttgcagaccaatatcatcggtacctctgtgctgatggatgcatgcaggaagtatggcatttcacgttatcatcaggtgtccacagatgaggtatacggtgatctgccgttggaccgcccggatctgtttttccacgaggatacgccgatccatacctccagtccttacagcacttccaaggcatctgcggatctgcttgttatggcatatcacagaacgtacggcctgccggtgacgatcagccgctgttccaacaactacggcccgtaccagttcccagaaaaactcattccgcttatgatcgcaaatgcgctggcagataagccgcttccggtatacggagagggacttaatgtgcgcgactggctgtatgtcgaggatcactgtaaggcgattgatctgatcctgcgcaacggaaccgtcggagaagtctacaacatcggcggacacaatgagatgaaaaatattgatatcgtaaaactcatctgtgaatatctcggcaagccggagagcctgatcgagcatgtgcaggatcgtaaaggacacgatatgcgctatgccatcgatccaaccaagatccacaacgagctgggctggctgccggagacgatgtttaaagatggtatccgcctgaccatccagtggtatctggatcataaggaatggtgggagaacatcgtaaacggggaataccagaattattacaaagaaatgtacggaaagaaaggcttataaatatgaaagtattcgtgacaggcgttgccggacagctgggacatgacgtggtaaacgaactgacaaagcgcggacatcaggcagtcggttcggatattgcaccgacactggaatcctgtgcatcgtatgtgccgctggacatcaccgatgcggcagcagtggaacagacaatcatgcaagtacagccggatgccatcgtgcactgtgcggcatggaccgctgtggatgcagcagaggacgaagaaaatcaggcaaaagtcagagccatcaacgtagatggaacgaaacatattgcggacgcagcgaaaaaagcagatgccaaaatggtctatatcagcacagactatgtgtttgacggacagggcgagactccgtgggagccggactgcaaagcatacgcaccgcttaacgtatacggacagacgaaacttggcggggaactggcagtagcacagacactcgggaagtatttcatcgtgcgtatcgcatgggtgtttggattaaacggaaaaaattttattaagaccatgttaaaagtggcaaaaaatcacccgcaggtgcgcgtggtaaatgaccagatcggcacaccgacctatacttacgatctggcaagactgcttgttgacatgatggaaaccgaaaaatatggttattaccacgtaacaaacgagggtggttacatctcctggtacgatttcacaaaagaaatttaccggcaggcagggatttctaccgaagtgcagcctgtgacaaccgcggaatacggtctgtcaaaggcagcgcgtccgttcaacagcagactggaaaaaaagaaactgaaagaaaatggatttacaccgcttccgacctggcaggacgcgctgggacggtatctgcaggaattaaagcgacagggggaactttaagatgaagggaattatattggcaggcggcgcagggacacggctgtatccgctgacgatggtaaccagtaaacaattgcttccggtatatgacaaaccgatgatttattatccgctgtctacactgatgctggcaggcatccgtgatattttagttatttccacgcgggaagataccccgagatttgaagcacttctgggggatggaaatcagttcgggcttcatctgtcctacaaagtgcaaccgtccccggacggacttgcacaggcatttttgcttggagaggaatttatcggagaggatgcctgcgccatggtactcggggataacattttctacggaaacggattcggaaaaattctgcgaaatgccgcaaaggatgcacaagagggccaggcaaccgtctttggctattatgtcaacgatccggagcgttttggtgtcgtggatttcgatgcgaacggaaaagccgtatccatcgaggaaaaaccggcacagcctaagagcaactatgccgtgaccggactgtatttctatccagcaggcgtgagcgcgatggcaaaacaggtaaagccgtctgcccgcggggaactggagattacgacgttaaacgacatgtatctgcagcagaaaaacttaaatgtgcagctgctcggacgtgggtttgcatggctggataccggaacgatggacagtctgttggatgcggcagcatttgtgcagatgatcgagcaccgtcagggtgtgaccatttccgcaccggaagaaattgcatatatcaatcagtggattgataaagaaaaactgcttgattctgcgatacgctatgggaagagtccgtatggagagcatttgaaagcagtcgcagagggcagagtgaaatattaaaatcagcgtaactattctgagggggttctgaatagatacaaatcagcatgaaagaggaaaaaacagtgggacagataacagtggaaaaaaatgtcggcggtatcgaagggctgtgtgtgatcacacccgcagttcacggggatgcccgcggatatttcatggagacatacaatgagagggagatgaaagaagccggatttgatatccattttgtgcaggataaccagtcgatgtccgtcaaaggcgtgttgcgcggactgcattttcaaatcaactttccgcagtgtaaacttgtccgtgccgtgcgcggaagcgtgtttgatgtggcagtggatcttcgcgaaggttccgcaacctacggaaaatggtacggagtggaactttccgaggaaaacaaaaagcagtttctgattccggaaggctttgcgcatggcttccttgtcctgtccgacgaggcagagttctgctataaagtcaatgacttctggcatccgaacgacgagggcggtctggcatggaatgacccggcgatcggcatccggtggccggatgtgacaggtgagtatcgcggaacgccgtcggcggaagggtattgcatgacggatggaacgccgctgacactttcggagaaagaccaggagtggccggggttggagaaaaaatagaatatggtgataagaaaaagtgatgatgtatgagaaaaaaagaatatatcatcactttttcttattaaaacagaattggattgactaccgatgatgatggagatagtatgaaaatatacttttgagataaaattgtaaaaaacaaacaaacttattaattctacatattattaatggagaataggaatggcaatgtttagaagagaaaagaaaaataattgggctttgattaatcgtgtaaaatatgacggcccttgtgatggttcgccctggctgatctataaatatccggaagaggactttgtatatggttcacagttagttgtgaatcagggacaggaagccttattttttaagggcggaaaggcattggatttattcggaccgggaacgcatacgcttaatacagggaatttgccacttttgaacaaacttgtaaatctgccgttcggtggagatactccgtttacggcagaaatttattatgtgaataaaacttcgaaattaaatatgaactgggggacacagaactcgtttccggtagaagatccgaaatacgggattttgttatccatccggtcgcacggtacatatggattgcgtatcgatgatacaagaaggtttgttgcggaagtggtaggtgtagttccgttgggggcaaccgtaacttatgaatttgtcgcagcatattttagtggacttcttgtatcgaaaattaaaaatgtcatttctgcatatatgatccgcagaaaaatttcgtttttggaggttaccggatatttggacgaaatatcagaagattgcaaaaacgcggtgaaagatgagtttgaacgatttggtgcggaagtcataaatttttatgtggaaaccatcataccgccaaagagtgactatgaaaaactcagagaatacaaagaaaaatgccttatgggaaaattgaaatgaacagaaagaaagcagaatcaaaaagaaaaaaatttcaccttaatcggattgcatttttatttccaattattttttatgcgatatatgcagtggtgtatctgattattttcccggatgcttatgggacgggattacacttgaataactggttatttaataatccggaacatttactttctattctgcaaaatccgggcaaagttcttctttcgacaggaaaattgtgggcatggaaaattttattatatattttatggacaggattcattgcttcattattttatctgggatggacaatccaaaataaaaaaccggaatatcatccgcaggctgtgctccgtggaagggaaccatatcaaaaagccctgcagataaatgaagaaataaaagcgcatgaatataacgtgacaagagaagtaaagacagcggttcgaaatgttatggaatatttgcggaatgagagtgattttggaatcggagataattctgtgattgcctgtgaacgagagattgcaaactgcctaaagacgatagaaaacaatattcccgcgttatgcaatacaaagactatgggaaaaacagaaaaaattattatagaaaactgtaaaaccattctgataaatctcaaacttcgaacagagagaaaaaaacgataaaaggaggcacagggattatgcagcatcaggttgttgagttagaatgtccgggatgtgcggcaataattacaacagggacaaaaacatgtccatattgctttcgccctattgtaattacttcgtttaacagtatccgtgatttttcatcacgggatctgaataaacaggccaatgtatataaaaaagcgatggcagatcatccgtacgatggaatattaaatacgtcacttgctttttgttacctgaaattaaaattgtatgacaaagcaatatcgtgttttgacaaagcactggaagataatttagaagattcggagatctgtttttatgcagcagttgcattgttaaaggggaaaaaggcatttttaacgtcgcgtccggttatcaataagatagaagaatatttaaatgcagcgattatgatcgagccgaggggaatttattattatttttgggcttatataaagtatgactattattacagaaaacattttagatcaacaccggattatcaggaattgttagaaacggcttcatccagcggatattcggaatatgatgtgcataatttgtttgatctgttggaagtaaagaaaccggatgccatgagatgacggaaaaacgtttttttatgcgatgataaagaaattaaaaaatacgaatgagaggaaagaaaagatgaattgtccaaaatgtggaagagagatcaggccaacagataagttttgtattgcctgcggggctaaattagaaaatgatggagatgagaacgaaaatttaaacgttgcatcgatgagaaaactggctggggaaacggtaaatcatgcagctgagtctttgatgggaacaagcagaaatggaattgattttatggtgcgccggtattttttcggttttggagattttatagctgtttcaatctgtgcttttgtgatcagtttacttttgaaactgtttttgggacatgaatatttgatgggacctatgaataagtttggttatttttgttctgtcattgaaattttggcgtttttagtatttgttgtatctttagaggagtctatgcatgcaaaatcaaatggcagagcgaaaacgaaagtcgatgaggccactcagaaatatatttctgagttaaaatccagagcaattgaaaaattcaatgtggatgaggaacagttggaagaagtagagccggttgttatagccggagcaggaacaacaccgcgtataaattctttaggtaatactgcaaatgccaaaaaaattgtcagccttttagaaagattttattcgaaagatccatttgaggcatacagggttgataaggatgctatgccgagatacttattgatacagactactgtttatgcgtttacggatacacaattgcttgtgtatgtaggaaatattgatatttcaacgggcatgatatatgacgaaacggtgtcggaagtgttctattcggatgtaaattctctcgtgcagcaggaacttttaaagaaatataacaaaaagtattatacggtaaaatatttgatgctggatatctgcggaatttccaaaatagctgcgtttgatacaagattagtccctgacgttaacgaacgcctggcaggaatggaaagctacataagagaaaaaaagaattaaagatttacagtggggagaaagaaaatgttttgtagaaaatgtggaactgagaatgaagatcaggcagtattttgcaaagaatgtggagcaagactggtcttgggaccgtcattggaatcacagataaagaaattggtaaagcgtatagcctctctgcctaaaaaatataaagtaggtgcgggaatcggaatcgcagccgtcgtggtgattcttattgtagtggccaatttaaattctaccatcaatttaaataactatgttacggtaacctttgagggttatgatggatatggaaaagcaactgcgacgattgactggaataaaattctggataaatataagaaaaagatttcttacacatccaaagcaaaatccaaatatgaatatgctttattcggatattcaatggaagaattactcgggaattgtgtttcggtgtctttagagaaggaaggcggactaagcaatggagatcgggtaaaatatgtctggaacattgatgaaaaccaactgaaaaagtatgtggactgcaaaataaagtattcagatgaaatcgtagatgtatcaggactggaaaagataaaaacatttgatccatttgaaaatcttacgcttacctatagcggaataagtccgaatggaacggttgcgataagttatacgggagatgtactggatgaaaatgaattttattgtgatacagattccggtctgagtaatggtgatgtcatcaccgtttatttaaattcggatgatatggaatattatgtagaaaattataaaatgatcccttccgagacggaaaaggaatataccgtggaaggactggataaatatgcatcttcggttaaagacattagcaaggaaatgattgctgccatgaaaaaacaggcagaaagtgtagttacagaatatacggcaaaaatgggttcggattgtacggtagattctgttacatttgtaggcgattatttggaaaactgtaaaaatgataattacgcagataagcagaattgttatggagatgtatacaaaatcaagttgcatgtaaaaccgtccgaagattacaaggctgttaaaatggttgagtattatgatgttcaattccataatatcgttgtaaaaggaaacggggaatgtgaggcagagctttccgattattatacaccgagtgagaatttttcgaaggactgttattatgggccggaagattatgactattatacttattattttgacggattcgaaacactggatgatgtaaaaaatgcccgtgtcgacagtgtggcagcagactacgataccgattggaatatggatggaggagatcaggcagaagtttcggatcaggggctgttgtgttcgtacagtaccaaaagaaaaatcaccgaagaagaaatacaggggtatttaaacaaagactattcttcctatcattttccgggggacagaagtgttattcagatgattattaatgaaatgtatgctttgaatggatataaatttcaggatgaagacttgaaaaattattatgaaaagcaggactggtacaataagattgaaagtaaaacaacggatatggcagaaatatatagaaatatgtcaaagaccgagcaggataacattaaattgctaaaagaatataaatagatggttaaataaaatatgaagaaagaatataaaaattttatcggcctgttgtacataaccggagcaatgtgtttttgcgtggcctgtggcagagatgtgcagacctctgtttattcacaggagagagcatctgagaatatgattcgggatacggaacaatcaggagaaaatacagagcaggaaagggaagcggctgtgcaacaggcaactgcacaggaagaaatacacagtagagatacagaggatacgcaaaaagataaaaatacagaaaacacaacagaaaaacaaaaatatacggtggttatcgatgcaggacatcaggcgaatggagattcacgattagagccgatcggtcccggggcaaaggaaaagaaacccagagtgtcaagtggaacgagtggacatgccagcggcttaaaagaataccagcttacacttgatgtttcattgaaactacaggcagagcttgaacacagagggtatcaggttgtaatggtaaggacaacaaatgacgtaaatatcagtaactcggagagagcgaccatagcaaacgatgcaaacgccgatgcatttattcggattcatgcaaatggatcgaaaaatacttcggtacatggagccatgaccatctgccagacctcatcaaatccgtataatggagatctgtatgacaaaagtcaggcattagcttcggcagtgctggacgatctggtgtctgcaacagagtgtaaaaaagagtatgtctgggaaacggattccatgagtgggatcaactggtgcaaagtgcctgccacaatcgttgagattggatatatgacaaataaggaagaagatttgaagatggcaaccgatgagtaccagaacaagatcgcagatggtattgcggatggaattgatgaatacttgcagggaaaataaaattacgttatgataacagtaggaaaagattgcggaggaaaaatagaaaaggaaaagaggtgaaaactaagcattcgtgcacagaaaacaaattgcgatgttgcggaatcgtgattcacacaaacaggaggaagcaatttgaaaaatgcaccagataagcttcagtggcatccggcgttttgtgccgccgcggggctggaattccacgaagatattgaacggctggagttaaagccggaatacaatctgagcaaggaaccaatccgcattgatcttcttattaagaagaaagtgataggcgaattaagaatgaaattggccacatcatgagaacctataatgtgatcgagtataagagcccagaagatgcactgactattgatgatttttataagacagttggatatgcatgtctgtacaaaggctatggagaacatgtagatgcagtcccgatcgatgaactgacagtatctattttcagagcaacacgactggagaaaatgtttttgacattgcagaagtatggacataaaatagaagaaaagtatcctggcatttattatgtgacagaacatttaccgtttccagcgcagattattgtgacacaggaattagagccgggagaacatcggagtttgcggattttgtcaaactatgcgaaaaaagaagatgtagaagaattcctgaggaatgtggaagaaatgaatacaccgcgtgaccgacagaatgttgaggctgtgttacaggtaagtgtcaaagcaaatgatgagttatatcgtgaaataaggagggatgcgaatatgtgtgatgcgttgagagaactgatgaaggatgatctggaagatgccagaaaactgggagaatcggaaggggaggcaaaaatcattatcaatatgaaccacagcggaatgaccccagaaaatattgcatccatcacaggaaagaatttggatgagatccgtgcaatactggaaggaagagttccggtggcactataaaaagcggttaaaaaataaaaaattaaaattgggactaaagtattccacacctcgtccgatatatataacaagtaagcaaggaaaccccgttgcttaccccacaagacagccccctgaccggagcgtacggccgtaaagaggaaaatcttacaatcaaatatcatatcaattacagcatggaagctgtaacttaattcaaggaggaaacaattatgggcatggtagtacaacataatatgcaggcgatgaatgcaaatcgtcagttaggaacaacatctggattacaggcaaaatcagctgagaagttatcttcaggttacaagattaaccgcgcaggcgatgatgctgccggattaaaaatttctgagaagatgagaagccagatccgtggtcttgacaaggcatctgataacgcatctgatggtgtatctcttatccagacagcagaaggtgcattaaatgagacacacagtatcttacagcgtatgaatgagcttgcagttcagggcgcaaatgataccaaccagtctatcgaccgtgatgctatcaatcaggagttacagtcattaacagatgaaatcgaccgtatttccgagacaactcagttcaataagcagaacctgttagatggtactttcacaggaaagaatcttcaggttggagcaaacaacggacagaagatcacaattaacattgcagcaatgaatgcaaaggcaattggattaagctcaggaaagacaatcgctacaagcgaatactatgcaacaaatgatgttacacagaaaaagaaatttggcacatcagctaccgtcagacaatctattaaagcacttgcttctaaaaatgcaacaattacaaaaaatacagcttcaactggatttaagacagtaacaggaaacattgttgctacttctcaagctgttagagcgagtgcagcagcggctgcaagtagagatgcagttcttttccatgttaatgcaacagctgcagaaagctttaatggaccgagagttgatacatatgcacatgcaaatgcaacaatcaatatggttcagaatgctattaacaacgtatctggtcagagatcagcattaggtgcattacagaacagattagagcatactatttctaacctggataatgtatcagagaatacacagtctgctgagtctcgtatccgtgatactgatatggctgatgaaatggttcgctacagcaagaacaatattcttgctcaggctggtcagtcaatgcttgctcaggcaaatcagagcacacagggagtattatccttattacagtaatcggataatctttaagaaagagttggcatatgccaactctttctttctatatacaaaaattattatgagggacgaatatgcatgaattattagaaaagctgtgctgtaataaagaaaaggtagaaacaattatacaaaaaatagaatccggagaaatatatatagatgagttaaaacagtatcttccgatgatgaatgagatagttacatgtatactttacgaggctaagatttctataaatgaggagtttctggtgcaggtattacatgatttaatagatggaattgaacgtcaggatgatgtaattttattggatacattacaatatggatggcttgaaatattaaactacgtaaatgataaattacagggtgaaaatatagatgaatagagaaatatatgaaaaaaacatggaggcacttaaaaataaatttccgatgtgggcggaaaaattagcgagtgtaaaacgaaaaaaacataattttgatgtgcttgcagaaaacagttattttggaaatacaattttaaaggtaaatgataatggaaagattctttatttgaatggaaaatacgcgccagatgaggtgggcgcaaactggattaaaaaaaatgaattgaaggattatacaccaattgtgattattgggatatcaaatgcagttcacattaaaaaaatcatagattgcgcaccgaaaacatgcaatattttaatatatgaaccttcgtttgaactttttcgaagagaaatggaagaagttgatcttgcatttttatttaaaaaagatattcctgtgggcattattgtagatgaattaaacgatatagaaatacaggactattttgatttatttatttcttatgacaatatggtgcttttaaaaacatacttatctggcaattataagaaactttttcctgaaaaggtagaagagtttgtaaagaaactgagaaaacatgtttttgatatagaagtgagttggaatacacaagttcgttatacaaatgttacagcaacaaatttatttaaaaattttccatatttgtgtgaaggatatggggtacaggaattaaagaatatattgccgaaagattttccagttattatagtatcagcaggtccgtctttaaataaaaatatacaggatttgaagcttgcaaaagggaaagcttgtatcatagcaacagatacagcaatgaaaccgttattaaatgcggggataattccggatttgtttgtgattgtggatggattaaaacccgggaaactgtttgaacataaagatatatctaaaactgcaatggtaacaatgacgcaggtatcggtagaaccaatggaactgcataagggaaaaaagttcttttattatagcggctccaaaatggaagatgagatattgtatgagttaagccgggcaaaaaataaagattgtacgctacctaatattccgacaggcggatcggtagcaaatacagcttattcattgggaattaatatggggtctgaaattattattttgataggtcaggatttggcattgactggaaataaaactcatgcagatggaacgtttcaagataaaatggaggagatcgatgtaaaaaattctgattattttgaagttgatgctgttggaggtgggaaagttttaacacgttcagattttaaattatacttggattggtttgaaacgcgcattaaagaatggaaaaatattactacgattgatgctacagaagggggagctttgattcatggatcaaaggttatgactttaaaaagcgcaataaaaaaatactgtaagaaagaatttaatgtaaaatggcatattgatcattcagaaaaattatttgatggggaaaataaagaaattgccgtaaaattcatagaaggaattcctaaaaaactaaatgaagtagaaaaaaaggcaaaggaaggtttgaggtattacgaaaaactggaatcaatgggtaaaaaatccaatattaatgataatcaggtattgaagttatataaacggataaaaaagattaatcattatatggaacaggattatatggcagagacagtaattgatagcttaaaaggtatggaatattcgttgagaccattagtttatcaaacgcaggataccatgaaggatgaattttcttatatttcggagcagggaaaagcgatgatgtatggagtggccataggagccggtgaaataaaaaaaattgaagaggaaacgattggggcatatgtgaaaaagttacaggaaagagagaaaggaaaagaaaaataattggaaaataatatactggatttagcgatagagaattttgaacaaaaaaattatgataaggcattggagttattaatattatcttatgaaaaagaagattgcaaagaatggatattggaaaatatttataattgctatattgctggaaacgaagaagagtttcgtaattcttttcaaaaatatactgaaaaaaattcgtataaatatgcatatgaggattgtttaatagattttattccatacagagagggtgagtattttctttttgataaagaaaaacaaaactttaatggaaaaatatctatgagtgaatttgaagattttgatatacaaagcttatttgggaaaaacgaattcagtgatgtcttaataaagtttgattgggattaccgaaaaataggtgtatttttaaaagtagcggaaacgggacgcaaagtgtatgcaattgtaaatgatgttagaagagcattatctttttggaagattccggaatgggaatcttatagggacaattttaaaatattttcctgcgaggaagaattccaacaatatttccacagaaatacggcagaatacttgccacggttggtatttacagaaagacaggaggataccgatctgcttggaaaaattattgaaatagagcatgaatacagactgactccggaagggcgcaataattctaatgtattattgacaattgggattccaacacataataggggaaatttacttttaaagagacttgagcatttaataaaaatgccatacgatgcggaagtggagtttgtagtatctaaaaatggttccgaattatatcaggaggagtataagcaggcaagcaagcttccagatagtagattgaagtattatggaattgatgagaccataatgccacatttaaattggtataaaacgattgagaaagcgcatggaaagtatgtgctgttagtgtcagatgaagatgatatagagattggggcattggaacactatttaaaaatattatctgagaataaaaatttaagccagattagagcgaaaacattttcacagtatttttttattgttgacagggaagaaggaaaaaagggactggatgcatttgaaaaaacgtttttaagacagaattatatatctggtttgattataaaaagagaggcatttttatctttaaatgttttaaactatgaaaaatatcaggacaatattttttatcgacattatcctcatgaatggtggtgtgctggcctgagcaagatggggaatagtttgcaagaaccggtacaattaattgtagagggaaaagaagcattatataaagaaattgaaacatacgaaaaacttggattggcgaaactggatgacgtatttgatgaggagagcaaggtgccttcgtatgcttcttatgaaagtagatttcaacaattttacggacaggtagaatttttaaaaatcttttttaaaaatgatctgataggtataggaaaaggaatggaaataataatccataaacttagttatttattagactttgtaagagagcgtggatataagaagcaggaatatttgaatgtgattgatcaattcgcaagtttaacaatagaagtcgtggatcaatttgcatttgaagatgaacaaaaacgcaagttattaaatgttattaagcatgaatgtgaaaatttgtatgcaaatcaactagaatatcgggaaaaagaatctgaaaatgatgaagattaatattaatatacaagaatagttggatggagaaaagataattgattaaagtatcagattatgtaattcaatatttagaacaactgggagtgcctcatatgttcatgcttccaggaggtggtgccatgcacttaaatgactctcttggaaacagcaaaaaaatccaatatgtggtatgtcttcatgaacaggcatgctccattgcggcagaagcatatgcaagagtcacaaataaaccgggtctgcttatggtgacaacgggaccgggaggcaccaatgctctgacaggtgtgactgcagcatatatcgaatcaactcctatgattgtattgtccggacaggttaaacgcgcggatatggtgaacggacagggaattcgtcagcagggcatgcaggaagtagatatcatttccatggtaaaaccggtgacaaaatatgcagcgcttgtaacagaaccacaggatatcaagtatcatctggatcgtgcgttgtatggagctgtacatggaagaaagggaccggtctggctggatattccgttggatgtacaggcatccatgatagaggaaacaaccttaagaggctggaaaccggcagaaatttcagaacaagaaaaaaatgaaaagagaaaacagctggaacaacaggtaatggagacaatcgcacaattgaatcaggcacgacgtcctgttttgctggcgggaaatggcatccgtctttcagaaggacgggacgaatttgaaaaactggtagagactttgcagattccggttcttacaacctggaatggaattgatctgatagaagaagaacatccactgtttttcggaagacctggtggaatgggacagcggtatgcaaattttgtacagcagaattctgatttctttttatctattggtgcgcggatgaatttattgcagaccggttacaattttgatggatttgcgagagctgcttataaagtgatggtagatattgataaaaatgagttacataaaatcaatgtcagaccgcagctcgcaatcgaggcggacgcaaaagaattcatgcagcttttgctggaacataaagatgagattcagaaaaaagattatacgccatggatcaactatgcaaaagagatgaaagcgaagtatccaattgtcacagaggaagcaagaacacaaaaagagttggttaatacatatgcattactggatacgattacagagcagatgaccgcagacgatatttatgtgtccggaagttcaggaacgtgtattgatgtgtcgatgcagacatttcgcgtaaaaaagggacagcgtgtattttgtaccaaaggtcttgcgtcaatgggatttggtgtgcctgcaacaattggagcatgtctggcaggtgacagaagaagaacagtatgtgtcaatggagatggtggttttcagatgaatattcaggaactggaaacaatacaccgtttgaaccttccaatcaagatttttgtactaaacaatcaggggtatgcacagattcatgcaacgcagaaaaatatttttcagggacattatgtggcctgtgatgcggattcccatctgacactttcaccgatatcggctgtggcaggggcatatggattaaaaacggtacagattcattcgaatgaagagctgcaggaacgtgtaaagaaaacgctggattatgatggaccggttatttgcgaagtgatggttccaattgatctgagtgcttttccaaaacaggtgtcctataagcgatcggatggacagatggaatcacttccactggaatatatgaatccgcctttggaacaggaagagtttgaacaggatatgttgattccgttgtatgagatgaagtagaatggcgtgtctatgggtagatgtcagtgaattacagataaatgagagaaagtaagagggtgtcagattttgaatgcaaagcaaagatttataaaacaatgtaaggaaaaattctatgaatgttataagaaattagatggcaaagatgtggtgctgtttgcggctggtggaagagcacatatgatggttctggcattcaaagaaatgggtataaaggcaaatatccgggcgattttggataaccattgcaaagaagaaaggtatattgaaaaaataccggtatataatgcaaaacgaattggagatttctcagatagcatatttatagtttgtagtgatacatacagacagagcatcagccagcaagttaaagccagcggaggtacactgtttgatattccggattgggaaggaatggtggaacagatgctcacgctacatgaatataaaacgaaggtagaacataacatcattggagatatatatgagtggattggaacagaatatgcggagaacagaatccgtgcagtagaagaaaagctttcagatgaaaagtcatgtgaagtttttcgaagacgaatggaatttctgcggaatggagatttgtatgattttatgaagattccggttgaccatgatgcatattttgacgtagatgagatgcattatacacaggacgaagtatttgttgactgtggagcttatataggcgacagtattgacggttatcgaaaacatgtaggtcaatatcggaaaatatatgcacttgaaccagatgtagaaaattgcaaaaaattcaggagtatgtagaaaatcagaaattgcaaaatattcaactgataaatgcagcagtaggaaaggaaaatagaacagtatcctttgatcagcaaggtacagcgggttcttctgttaagggtgaaggaaataattctgtaaagctggtttgcttggatgatgttatagcagaccctgtcacttttttgaaaatggatattgaaggatttgagttggatgcattaatgggtgcaaaaggattgatagagacatacaaaccgaaattagctatttgtgtatatcataaatgtgaagatccggtaagtattgttgagtatttagcacaactggtaccagaatatcagttttatatgcgccattatacatatagtcagcatgaaacggtattgtatgcagtataggatagaatgaagatggaacgtaaagggaatgaaatcaaaaaagttgtcatgactggtggcagtggtccgatcgggcttgccctgatccagaaattattagaggaacatgtggaagtttttttgtttcagagagaacattcttttcgatccgcatttgtaccggagcatgaacatctacatatcgagcactacacactggaacagttgaaggactatgaaccggaagaaaatgattatgatgtattttttcatctgggctgggcaaatacaggaaaaactgttcgtaataatatcgaggaacagagtaaaaatgtccggtattcaagttatgcagtagaggcagcacataaattcggatgtcacacatttataggagtaggaagtcaggcagaatatggacgaaaaaaggagccacttgccggggatatgctctgtgaaccggaaagtgcgtacgggattatgaaactttgctcctgtcatactacgagaatgttatgtgataaatatggcatgaggcatatctggccacgtgtattaagcggatatggaaagtacgataatgatggatcggttttgattgcaaatattgtcaatagtcttcatcatcgccctttagcattctcaaagggggaacagatatgggactttgtgtatatggatgatattgcaaatgccttatatctgattgcaaaatatggacgaaatcatgcgatttatccgattggcagtggaaaagccagacctttaaaagaatacattaagatcatgtgtgatcaactgggcgaggatatcagagaaggactcggaaagataccatacagcccggatcagatcatgtatctggaagcggacagcagtaatctgatagcagataccggatggaagccgcaggttgaatttgaggaaggcatccggcgggtgatcgactttcataagtcatgggatgtttataaataacattcagaaatatcgatatcgtgataatgggagaagtgaatatggagataaataattatatttcaacaataaatgagatttataaatgcttgcaggatgatgagtcgagagctttatatgaagcaaggattgcatatttgttagagcgggatgaagacaggtatatatcacgtataggaaaaatatatcaggactggtatagtgcagaagatctaaagagggaactggaaaccaggatatataagaagattataatttttgggtgtggttatctgggaagtatgttaaaaggtcagttgcagtgtatgggatataagacagattacttttgtgataattatcatatgggtgaatttgatggcttagaggtattgacagttagtgatctggtaaaaagggattggaaggatagtatcattataattggttcttataaataccaggatgagatgtatgaacagttacttgtaagtggtatttcagaacaaaatattttgaagtacaaacatatcgatctgttcggaacaagaggatggcaatattttgatgtattttcaccacagaatgatgagatctttgtggatgcaggagcttttaaaggagaaaatatatttgatttttgtaaatggacaaatagcaagtataggaaagtatatgcatttgaaccaataactaagtcgtatgaggatatgaaaacagatattatgacaaaagggttacatgatgtccatgttataaatggtgcaacatggaataaaaatgagcagatacatctggtggaaaatggatcaagtacttgcatcacagaaaatggatcattagtgattcaaggatatgatattgattctatagttggtgaggaacaggttacatttattaaaatggatattgagggaagcgagttaaaggcattagagggagcggagaagaccatcaagagacacaagccaaagcttgcaatttgtatttatcataaaccgatggatgtgatagaaattccatcatatatcatgcgattggtaccagaatataagttttgtataaggcagtatacctcacgcatgtgggagacggtattatatgcaatagctgaggaacagtaaatgcagtataaaatcaaaagaatacataaaaatcatgtgtgattaactgggaaagaatgtcagggaaggacttggaaaaccggatggaagccgcaggttgaatttgaggaaggcatccggcgggtgattgattttcataaatcatgggatgtatatcagtagacaaaaatttgaatataatggagcagacgatgaaggatgaaatagcatggttagatgaaccatacggatgtgataagcagcaaaaaagggcgttgcttacatcaaggttgaagtatttaactaattatcatatggaacattgtgtagaatataaaaatataatggacacatttgattatcaggaagaacaagtgaattcctatgaagatcttccatttcttcccgtccgtatttttaaggaaagatcccttaaaagcatttcagatgatgcggtgatcaagactatgacttcatctgggacaactggacagtctgtttcaaaaatatatctggataaaatgacagcagcaaatcaacaaaaagcattggttaagattgtatcggatttcacaggatcttcccgcatgccaatgattatcattgattgtccttcggtagtgaaggatcggaagatgttttctgcccgtggagccggaattcttggattttcaatttttggatcaaagagaatgtatgcacttgatgatgatatgcatctgaatctgtcagaactaaaagcttttttggaaaaatataaggatcggaaaatactgctgtttggatttacatttatgatctggaagtatttttatcaggaacttgtacgccttaaacaagaaatgggagaacagattaacctgtcgaatgcagttctgatccatggcggtggctggaagaagcttgcatccgaagctgtttcagcggaagagtttcagaatcgtatgaaggaaatatgtggtctgtcggatatccatgattattacggaatggtagaacagaccggctgcatctatatgcagtgtgcgtgtgggcatcttcatgcaagtaatttttctgatgtgatcattcgcaatccattagacttttctatatgcccgaatggggaaaaaggactgatacaggttgtatcagttataccggaatcttatccgggacattctctgctgaccgaagatgagggaatgattcttggcgaggacgattgcccatgtggaagaaaaggaaagtattttaaagtatttggaagaattaaagatgcagaaatccggggatgcagtgatacctacgctgttgatcagagtatcaggcagaaggcattggcggatatacaggacatacagacctatcagaagatatcctttctggttggaaatccggcgatgatacagaagatgacacaggtgacaccgatgcagccatttgcagcagaagtacttgcctttttagaagatttgtcaaaggaattgatgacagacaaaaagtgcagattatatccggatattgttacgcttgggttctggttaagaaaatcgtcgttacatgaattaaagaaaaaatatctgatagaagatagtgaaacgatcaggattggaaaaggtatggcgtttcatattgcaccatcgaatgtgccggttaattttgcatattcattgtttactggattgctggccggaaatgccaatgtggtacgtgtaccatcgaagaattttccgcagatagatctaatagcggaaagtgtaaaaagagtattagccagacatgaagatatgcaatcttatatcgcattgataaggtatgagcggaatcaggatgtaaatgccttattatcgtctatgtgcgatgttcgcatagtctggggtggtgatgcgacgattgcggagcttcggaaaagcaggctgccagcgcgtgcaacggagatcgcatttgcagataggtattcacttgcggtaattgatgcggactattatttatcatgtatggatgcggacagggtggcacgggatttttataatgacacgtatttgtcagatcagaatgcgtgtacgagtccgcgtgtggtcgtatggtatggggaaaaaaaggaggatgcaaaagaaagattctggaaggcattatatggactggcaaaagagaagtatcatatgcaggcagtaacaagtgtggataagctggtgacaatatgtaaagctgcatccgtggatgaaactgaaaatgtcggaaagatacaagtgatgccacaggaggattatcttctggttcgattgaaagttgacaaacttacgccggaacttatgcgatatcgaggtaatagcggctgcttttatgagtatgacgccacagatcttttatccttaagagagttttgcaacgatacgcattgtcagacattagggtatattggaaacagggaagcatggaagccactactcatgtccggattaaagggtgtagacagggttgtgacaattggacataccatggattttgatttggtatgggatggttatcatttgataaatagtatgacgagagtaattgcagtcagataagaggtgcttatgtgggatttacaaaaatatgaagatcagacagcaatcattgatgatcagggaacacaggtaacatatcgcgaattgttggatatgcagcaacggatgaagaaaaaagtgacaaaacgtgcattggtggtgtcactgtgccgtaacagcgtaggatctgtgactggatatatcgcatttttgaatatacggcttgttccaatgctattaaatgcacaattagagcacggattactggcaaacattctggctatttatcagccggcatatttatggataccatcggaacgagtatctgaagatatattttctagtctggaaattgtatgttctgaatatgattatacgttgctaaagaccggatatgaaacagaatatccgctctatgagaatctgggattactactgacaacttcgggatcaacaggaagtccaaagtttgtacgtcagagttatgcaaatattttgtcgaatgcaaaatccattgtatcatatttagaactggatcagacagagcggccgattacgacattaccaatgaattatacctatggattgtctattatcaatagtcatctgctggtgggagccacccttcttgtgacagataagtctctgatgcagaaggaattctggacgttttttaaagaacagaatgcaacttcattcggaggtgtgccatatacttatgagatcttagataagcttcgttttacacggatggaacttccatcacttcggacaatgacacaggcaggtggaaagctgactaccgaattacatgcgaaatttgcggagtatgcggcagagaatggaaaaaggtttgtcgtgatgtatggccagtgtgaagcaacggcgcgaatgggttatctgccggcagaaaaggcagttgaaaaatgtggttccatggggattgcaattccagggggaagttttaccctgattgatgtggatggttcaccaattcaggaagcatataaaacgggtgagctggtatatgaaggagataacgtaaccttaggctatgcggagtgtggagacgatcttttgcttggagatgaacggaatggcattctgcacacaggtgatatggcacagcatgatgaagatggttatttttatattgtaggcagaaaaaaacgttttttaaagatttatggtaacagagtcaatttagatgaagtcgaccggctgatcaaaggcgcttttgatgagatagattgtgcatcggcaggtgtcgatgaccatttatatatttttcttacagaggaaagtaaagccaaggatattaaaaactttgtagcagaaaagaccaggctgaatccggcagcatttcagacgatcacgattgatcagataccgaaaaatgatgcaggaaaaactttgtacagagaattggaaaagtattataaagaactatagtgggggtaaagaaaacaagagtgaagaaagaacagaagatttttgtgacaagaacatctatgccgccatatgaagaatttgcagaaatgatcaaaccattgtgggatacacattggctgacgaatatgggacagtatcatcaggaattggaaaaagagctgcgtgactatttgcaggtggaacaattatctttgctggtcaatggacatatgtcattggaaatgacgattcaggcgatgcagtttccggcaggcagtgaagtgatcacgacaccatttacatttgtatctactacacatgctattataagaaatggattaaaacctgtattctgcgatattaagccaacagatttcacaatagatgagacgaagatagaatcactgattacagatagaacggtagcgattattccagtacatgtgtatggaaatgtgtgtaatgtagaggcgattgaacagatcgcacaaaagtacggattacgcgtaatctatgatgcagcacatgcttttggagaaacatatctgggacatgggattggcagctttggagatgcttccgtttttagctttcatgcaacaaaagtatacaatacaatagaaggtggtgctgttgcatcaaaaagcagggagttatatgagaagctatataatctgaagaatttcggcattcaaaatgaaaatgtaatttcagatattggagccaatgccaaaatgaatgaatttgctgccattatggggttatgtaatttgaaatatgttgcacagaacattcagatccggaagaaaaaggttcagttatataatgagcagctgaaagaggtctcttatgtaagaacaccggaatttgatcacccagatgtgaagtacaattatgcgtattatccggttgtgctttcgacagcagaaaagagggatgaaatatatgatgcattacatcagaagaatgtctatagcaggaagtatttttatccattaacggcagatgctgactgcttcggatcacagtatcagacatgcccattagatgtcgcaagagacatatcttcgagagtcttagttctgccattatacccggaactggaggatgagatgatcatgagtattgcacagatgattcaggaattatataattaagcagatacataggaatgcgatacgattgcatatatggagtagaaaatttatggaagatcaaaagaaagtagaagtatcggtatttgttcctgtctataatcacagggaatatatagcacagacacttgacagcattcttatgcagaaggtgacatttccttatgaaattgtgatccatgatgatgcatcaacggatggaacaacagaaattatcagggaatatgaggcacgatatccagttattattcgatgcatgtatcaaacagaaaatcagtttagtcaaggaaatttacatccgatatggaactgtcagttatatatgtgcaggggaaaatattgcgcgatgttagaaggcgatgattactggtctgatccggataagttacagcggcaatatgattatatggagtcgcatccagagtgttctttatatatgcataatgcatggaaactggatgtgcagactggaagcaaggtattattaaatactttttcacagagtggttactattcacagcgggaacaggtgttatgtggacttggatctaagttccctgcgacaggatcatttttttttgttttagaatatcttcgtaaagatttgccggaatttgtaattgaggctggagtaggtgattatccaattcgccagattgtggcaaataaaggagcggtctattatgatgaaaggccgatgtcggtatatcgttatatgacacggggatcatttatgaaaagtatccgcgataacatggacaagtatgtggactatattgtaaaaatgtgtgtattctatcaacggtttagtgagtatctggatcacaaatttgatgatatctattccatgaaaattgattctgatattcttggtatggcagcagcaacgtatgattgtagagaacaagtagagccggcgtggctgcaaaataagttggatatattttaccggatgttatccggtggacaatggattgaggatgtgaaaaagctgctggatagagatgaagcggtatggatctatgggacgagcacattagctgctatttgtaagcagagtctggaacagggaaatataccggtcaagggttttgtagtttctgatggatatagtaaggcagatacctttgatggatatatggtcaggtatgtcagtgagacgaagggaaataacgatttttatgtaattgcggcacaaccgattaatcaggagagtatagaacgcgtacttcatacaaatggagaagcacggtattactcaccatatcggctcagtaaagaggaaaaataaatggttttaggtatttatggtgcacatggtttggcacaggaagtacatataattgctaaaaagataaatagtgtggatggacgttgggatgagattgtatatatcgatgatgtgaatgatatttccgaacttcagggaaggcgtgtgtataagtttgaagaacttttaaagacctataccaagaaagaccttgagattgtcatagcggttggtgagccggcagtcagagaaatgatgtatcagaaagtgaaagaacatgatataaaactggtttcactgattcatcctggcatttatctggatgagacaacctctatcggagaaggtgttgtaatctgtgaaggtgctacgattactagcaatgtaacaatagaagataattcctatgtccaggctcatgcggtaatcggtcatgatattcagatcgggaaacatacgatcattggttcaaattgtcagattggtggtgctgatgtgatcggtgacagagtatttatgggatttttatctggaacaaccgatcatattcagattggggatgatgtgatcatatctgccggtgccattgtttttaaggatctgccggatgaagtggttgcagttgggaatccggcaagaatcatgaaaaagaacgagcaaaaaagagtttttaaataacaaggatacaaaagggaggagatcgccagtggaaaaagaaatattaaaatttgacacgatgggtatccagaagtgtcagagaaacagatatccattattgtttattgatagggtagaagaagctgttccgatggaacgtgcacatgcaatcaagaatttttcgtataacgagtggttttttccggctcattttgatgatgaaccaaatgttccgggatttgttcaggtagaggctctggcacagacctttctaatgacattcctatgtgtagaagaatatcagggaatgaagacagcgtttgttaatattgataagacaaaatttaagagaaagattgtaccgggggatcgtctggatatttatgcgacgttggattcctttaacagaggagtggcgaagggtcatgtggaaagttttgtagatggagaagcagcatgctcggcaaagctggtggttgcaattcctgatgtactaaatagatataaaccaagataaaggactataagaatgacagataaagaattagaagtgtttgctttagcaatacgaaagagaattataaaaatggcatatgagtgtaactgcaatgctcatttaggtggtgcattgtctatggtggatatacttgctgttttgtatggggatgtcttacgcaatgcaggtggttcttatgacgaacgtgacaagtttattcttagtaagggacatggagcattggctttatttgcaacattgggagaaaaggggatgatttgtgaggaacgtttacatacgtatctggcagatggcagtaacttatgtgcccatccggtaatggaaccggaaataggaatcgaatcttccaacggaagtcttggacaggggatttccatggcagttggtatggcactttcttctaagcgtaagcaaagaacagatcagatttttacgattgttggaaatggagaaagtgatgaaggactggtgtgggaagccattgcatccgcatcacagtttcagttagataatttaacggtgattctggatgataataagtttcagaacgatggcgcaagtgaacagattctgtattacccgaattataaggaacgttttgcggcatttggctttgatgtgatagagataaatggaaatcatattccagagattgtacaggctctgcatacgccgcacatcgaggataagccaagagcaatcgtagcaaatacagttaagggatgcggaatctcttttatggaaaacgacaatagctggcatcataatcgtttgacacaaaagtattacgaacaggcaatgaaagaattggaagaataagtatatggagataaaaaaatcagaaatcaaaagatgggcaacgatgggatcaagagctgccttcggaatgggaattttaaaattatatgaagaagaaccggatttctttgtaatgtcagcagatctcggaagttcatccggacttgccagattctatacaaagtacccggaagcatttgtgaatgttggaattgcagaacagaatctgattggtgttgcgtctggtctggcaaaagatggaacaccggtatttgcgacctcttttgctccgtttatttcgatgagagccagtgaacagatccgaatgaatatgggatatatgcacttaaatgtgaaggcggttggaattggaagcggactggcgatgaatacgcttggatcttcgcattttggattagaggatatagcagtaatgcgtacgataccgggaatgacaatcctttgtccatcggatgggttacagattgtgaaatgtattgaggcagccaggcggtataatggtcctgtttatatccgcttatccggtggatcggatatcatttatggggaagatttccactatgagatcggaaaatctattatacttcaacaaggggaaaaagtggcactggcagcaacaggatctattgtttcacagacattacaggcagcagaaattctgaaagatcatggaattgactgcacagtgatggatatgcatacggtaaagcctctggatactgagaggttagatgcgttgaaagaatatgaacttgttgttaccgtagaggagcatactgtcattggtggattaggaagtgcagtggcagaatattatgcatgcagtgcacaaagacctagacagcttattataggaatcgaagatttttatcctcatccgggaagttatggatatctgttagaggaatgtggactgacaccgggaaaaattgcagaaagagtaatgaatgtatatgctgagagataaaaatattgttattacgggcagtagtcgtggaattggagctgccattttaaaagaatgtgcagcaaatggtgcaaatgtgttcgcatgtatgcgtacatgtagtgatgagaaggaagctgaactgcggaacatagcaaaggaatataatgtcagtatttatccgatttgctttgatctgagtgatgaaaaacagattaaagaggcagcttcccagattttaaagtataaagttccgatttacgggattgtaaacaatgccggaatggtaggtgctaaaaatctgtttttgatgacatcaatggaagaaatccgcaagacatttgaagtgaatttctttggaccggtattttttacgcaacgccttttaaagaatatgatcaaaaataaagcaggatctattgtcagcatcagttcagcagcagcacttgatggagatccggcccagtttgagtatgtttccagtaaggcagcaattcttggagcaacaagaaaatgggcgaatgaattagggatttatggtatccgggcaaatgcggttgcgccaggtgtgactaagacagatatggtcgctgaaatgaaaacagaattacaggaagcaaccatccgtaatacagcaatgggacggatgggaacaccagaagaggtagcaaaacaggttacattcctattatctgatcaaagcagttacatgactggtcagacaattcgtgtagatggcggcctgcacccataaggaggacagatggaattaaaagataacaaaagggttcttcaaaaaatgagggcgtttgacaaatatatcagtaaaaatggaaatgtcggtactgcaccaagaggaatcttactcaattacagtaatgcttgtaattttaaatgccagcagtgtttcacacagtctccgagcagaccggtatgtgggacacttaccttagatgatatcagaaagctggcagatgaggcagatgaactgggaatgtatgaagtcctgattgaggggggagaaccactggtctgtaaagacctatatgatattattcgaatttttggcgcagaccggttttatattgagatgacttcgaatggctatcttcttacgaaggcggttgcacaaagattaaaagcggcaggtatgtccagggtgtcaatcagtctggacagtacaaaagccgagatccatgacagataccgaggtgtcaagggggcttatgagcatgcgatacaggcattagaaaatgcaaaaaatgcaggtatgcaggcatcggttaattttttggtggggcattataatattcattccggtgagatagaagaaatagcggaattctgtcagaaaaatgattatcatttttcgattgtaccggcaacaccgaccggaaactggaaagctaagtttgatgttatgctgactccggaagatacggcttatctggaaaaattaagaacaatatataagcacttctggagggacatctggccgccattaccaaataagaaagtaaaggtgagcggctgtatagcggtaaatcggccatacattaatccatatggagatgtcctgccatgttcctacttacatatgaagcttggaaacattaaggaaaagccattaaaggagattatggaatatggattctcatatccatgctttggaaatccgcacgaatgctgttatgctggagaagatccggagtttatggagaagtattgcatgaacgatatgtccatactagatccaattgatattgaaaaagttttagaaaagaacgacaaatagaaaaggagaagaaagagatgactaatttagaaaagtatgtaaatgcatttgtagagggacttggagtagaggaagatgttgtgaattcaaaactggaatatcagtctgttccggaatgggattccgttggtcatatgggactgatttcagagttagaggaagcatttgatattgagatggaaacagacgatattgtagattttaattcttacaatacaggaatcaagatcctcaagaagtacaatgtagagatctaataattaagaatcatacgaaaggtgaagataaatgaaaaaactaacacctcctattagaaaagatcgaaagccattgcaggatttgcttccactaaagcagccgcttcgtgtgaatatagatccatgtgatatatgtaactttaaatgtgatttttgctttcaatgcaaagatactggatttaaaggcagcattatgactacggatatgtttgaacgtgtagtagaccagttaaaagaatttgcagaaccaatcaatgtggtgcatctgtatgctcttggcgaaccgtttatcaataaaaatatgccattattcattcggagattaaaggaggagggcgttgcaaaggaagtaaaaacaacgacaaatggaagcctgttatcaccggagatgatcgatggaattttagaagctggtctagatgaaatatctatttctttaaatgggttaaaggatgaagattttaaacgaattgctgctgcgaatgtaaagtttgatcagatgtatgataatctgaagtacctttatgaacgaagaggcagttgtcatgttcatatcaaaataattggagattattttagtaaagaggagcagaagtatttcatagaaaagataggcgagcatgcagatacgatcaatattgatggactgacaaatcattggtctggtctggaaatgacacaggggggcagacagtataatacaatggaagaaacagatcagtgtacaatttgtgccctatgtttttatgaactgacgatacacagtaatggtactgtgagcccatgttctgtggattggcagatccagaatgagacattaggttcaattatggatatgacattgaaacagatatggaactcgaaaaagagaaatgacatgttggtcagttttttagaaggaacaataaatccttataaagcatgcagggagtgtgaatatcctaattcgggtgcaagcgtgaatttggatccgtatcgggaggaattgcggaagaagtatgtatgagaaagagattgagcagcaaaaacggaatattgttgagatggtgcatgcaaacaggatagaagcacatttatcaccggcaatggcaatgatggaaatatttaatgttctattacgggatataatgaatattgaaaatggcattgatgatgagcgcagtgacaggctggtgctaagtaatggtcatatagcacttggcttatatgccgtatatgagagtatcggaattctttcaaaagaagagttctatacgtttggaaagcgggataccagaattgcaatacatcccgatcgccatcatacaccggggatggtaatttcgaccggatcattaggacatggactggcaaatgctgttgggctggcatatgcatggaaaataaaaggaaaagaaaacaggatctttgtaacagtaggcgatggggaattgaatgagggcagtatctgggagagcatgatttttgcagcaaggatgaagctggataatatctgttgcattatagatgataataagtctacagaatatatgccggatatttctggaaaatttcactcatttggctgggatgtcgtagaggtaaatggacatgatgaagaaggtcttcgcaaagcactatcacaaagaacagaagaaaaaccatatgctgttttagcagatacgattaagggacatggtatttctttgtttgaaagagaaccggatatttggcattttaagggtatttcagatgaagaatatgcaatgatattagaggatctataagaatgaacttaatgatttcacaattttatcagacatcaaaagctgttttggaaatggatgacagagcagttgtattgatggctgcgtctggagcatttctttttccagacctaaaaaggaaatatccacagaagtttgtagaggcagtggatgttggcattatggaacagtctatggttagtattgcggctggaatgtcaattgcaggaatgataccgattatatatgggcagtctccgtttattattgaaagagcatatgaacagattaaagtggattttggttatcagcagcttggaggaaattttgttggctttggtgctagtacagaaaatgcaatttacggagctacacattgctgcccggctgatcttgcagtattaggtatgatcccgggaatggaaattgttgtcccggggcggccggatgaatatcataccttatttctagaggcgtatgcagacaatcacccgacttattacaggattactcgttattgtaactcgtataataaaccggtaatgtttggtaaggctaatatagtgaaaaagggatgcaaagcaactgtgctggcggtaggtccaatgcttgaacttgcaatgcaggcgtttaaagacgaagatgtaacaatcctttattatacgaccattgttccctttgatgagaagactttgcaggcaaatcttgtgaatgatagattgctggtaatggaaccagcatatcagggtggaatgttgccacagattgcaaaggctttacatggaaacatgatgaaaatggatttggtaggctatccattagaatttattacaaatcatggttatgtagcagataatgcatcaagatatgggttgacagtagaacaggtaaaaagcagatatcaggaactgataaagtaggtgagacaatgcgaattgcggttacaggtggtagtggatttataggacagtattttatacgggattatggaagtgcatatgagtgtgttgtacctgtgagggatactagtaagatgctcaaaaaagcggggaatataacctatctgaaaagcgattattcgtttcatagtctgatgcagattttttctggatgtgaggctgtcattcatctggctggtcagaaaaatttatcaacgcagacacaatgtatggaaaatatacagttcagcagtaatgtatttgaagcctgtaaagaacttcaaataggcaatattattaatgtgtcttcccgggctgtctgggggaatgaaaggttttctgcaggagagagtataaatgaagtcgaaaccccaaaaccggataatatgtacggattgagtaaattgtgtgttgaaacattagcagattattataatcgcacctatggcatgcatataaagtcatatcgaatgggagaggtatgtggattagaccttaaaaagggcatgacacatatattttggaaaaacctattggaattatcagtagctaatcaaccgattccaatctatggaacgggtgcaggtggacgagatcttatttatatcaaagatgtaattagggctctggatgtgggattaaaagcaaaggatgtgtcaggaatttttcatattggaagaggtgctgttttaacaaatcttgaaattgcgcaggaattctgtagaatttttttgaatcaggcaggaatctgtctacagacagaaaaggatgatggaggaacgaagtggcatctggatgtgcaaaaagcaaagcagattttagattatgaaacaagatacgatttgaaatctatggtggaagatataaaagtagaatatttgaagtttgtcggtcaggaaaaggaaatataatatggggaaaaaaaggattataatatttggaacgggatctattagtaagtatctaacagaacacctaaaaagtgatgtggagattattgcatatctgacttcggatggagcagatgatataaatggtaaaacagtcttgccattgaatcagttacggacgatagagtatgactatattgttatagcatttggaaatacacccaaaggaatcgaggttctgaaagcggaaaatgtgccaccggagaaaatagtaggttatgcatatagtggatcggattatgaaacgaatcttttgcagaaggaatgcgatcgtcttgttcatgagtgtttatcggatgaaagaataccagaattatttgatctgccgcagaagagatactatgtgtgtgggatgaatattcaggaaaatcagaatgttatatccagagattatgtaagagagcagaccttgtctcttttagcagaggagatcgtacgaaagaaagtgccggggaatgtggcagagatcggtgtatcacaaggtattctggcaagaaagatgaatatcttgtttccggacagaaccttatatctgtttgatacatacaatggtctgccggaagaggataaagcaagagcagtcagtcagggatggggagaaaaactctatgcgctcggagagagaggaacgcctgttgaaaaagtgttagagatcatgccctaccgggacagatgtgtgataaagcagggaaaatttccggatacatttgatttacagggagaattggcactggtcagtctggatctggatttttatgaatctacaaaaagaggacttgaagttctatatccacatttaagtgaagggggatatattatggtacatgattataataaccttgcgtttacagaaacaaaaaatgcagttacagaattttgtgatgagcatcatgttgcatgtgtaccaattccagatgtggcaggaacggtagtattagtaaagtagtcagaagagggagaatagattttgattgtttatgtgaaggaatgtcaatatgtttcattaaaagacatagtgacgtggataaaaaacggaattgcagttcaaccatttaagtcaaaagcggatgtgagggaaaatgatgtagtaatcatgtcaaatcgggatgaagatacggatattaggttaacgatgaacaatgtattgatctacgaggacttttttgaaaaagtatcaagtagtattatacaggaattttgttataatcatgattattattatttaaagaatgctctttcacgcgcgaaggaatcggatataacgacacttatctcagggtcatcttatggagttttgggaatagatccatcatatattgagaatacggtaaatctatcctctatttcacaagatttgtattattcttcaagcttggtcaagggagcgtgtgcgacgaacctgaatataaaaaatatagtgttttgtgttggatattattatttttttacagatctttcaagaacacagaatcaggatgaaattttaaggatatcaaaagtgtacaagccattacttcatgacgagcatcattgtatattacttccaccatgtaataaaatgctttatgagagcaatatatttgatattgaaaaagtttttgacctatatacctggggagaatatacaaaaggattttttaatcagaacagacaaagaaaagattttgctgcaaaagaatgggatgataaatcaaaaagttggtcggagttgagttccagggagaaaatagaggccggtaaaaggcgtgcagaattacataaccggagtataaaaagagaatccagctttttcgaaaatgtaactattttacaagattttctggatttttgttcaaaaagagaaataaatgtcttatttgttataacaccggttacatcctattacttagactatctggatcccgattttaagtctgaattttacagggtacttaatgaagtaaatggaattgttcatcttttggatctgtcagataataaagagtttgtagatgcggattttaatgatacagatcatttgaatgatagaggagctaagaaactgactttaaatattgtacaggcattagcggaaatgtaaggggggataaaatgctgcaaagagcatgtccggtatgtaatggaacaaaacagaccgtaattcagaacataaaaatgaacgtaccggaggattatcatcttccggtgcaatatgatgtcgtagcgtgtgcagactgtggaatggtctatgcggatacggcagcatctatggaagattatgactggtattatacacattgcaacttctacggtgatgacagcaaggatgacaacagcgaacgctatgactggatggaagagctgttagagaagtatctgacgaaggattcggtgatgttagaattaggagccggcaacggaagatatgccatagcgttaaaacgaaatggatatgctaggatcactgccaccgatccatccggggaaatcgttgagcggttacagaaggcaggtgtgaatgcctatgtgacgaatatttatgctgatcctgcatcggacgaacagggaaaatatgatgcagtattcttatttgaggtagcagagcatctgcttcttccgcaaagaggaattgcgaatatcgcagcgttactgcggatgggtggatattttatgctaagtgttcccgattattcgctgattgcggaagatacctgcaatattccgaattactttaatctggagcatatcaattatttttccgaggattccctagacaccctgatggcgcagtatcagttaaagcgtgtagatcaaaagaggctgggagcagatctgatacaggtctataagaagacgacggaagaactcatgcggaagagggatgagaaaacagaggcagcagttagacagtatctgagccggcagcaggaacgtcaggcacagattgaagcgaaggtcggacagttacagaagcaggagaaggagttattcattttgggaaccggttcttatgtgatgagccttcttgcgactacggcattaggcgattgtaagatccttggatttgtcgataacaaccggatcaagcaggggcgtgagatgtatggacgtctgatctatgcaccggagtatttattggacaagcatggtacggtagtgatctgttcgatgctctatagtacgcagatcaaaaagcagttagaggatatgcataccgaaaacgagattgtaattttatagggaggatttatatggatacgaatagaaaagcaatagaaaagttactgacagaagaaaagagagagctttcgaataagcacttatggatctggggtgccggtgatacggccgttttataccagcagggactatcgagaattgaagaggaaggattcgtaattgaaggatatgtggattcagatccgaaaaaacagggaaatacgattggaacaaaacagatttgtgatccggaagcattatacaatatagaagatgtatgtgttcttatctgcagtatccgtgaagaagttttgcatagtgtaaaagcagaactggataaaaggaagattgaaaactattacctggatgaggtgattttaaagaatcatgcaaatgaggttttagcctgctatgatgcactcggggatgaaaagtcaagagaagtatatgcagggattatacagtggcgtgttacaggatgcaggacacgctatccacttaacatgacagaggattactttgtattagattcttttaaacgcagtaataaagatgagatatttgtcgattgtggagcttatgtcggagatacgattgaaagttattgtgaagtgaaaggtaacaattttaaaaagattattgcatttgaagcagaccggattaattaccagaagttagagaagaacattgcacggctgaatcatgaatatggattatcagattcccagattgttatacataattgtgcagttgcggataaaatgggaaaaattgttttttccagatatgagaacaatgatggaattggctctaagattaccaattatgaagctgaaggagactgtgatgttatctgcctggatgaatatctgaaagaaccatatacctttttgaaagcagatattgaaagctttgaatatcgtatgttacagggagctaaaaagagtattcaggcaaacagaccactgttagctatttgtatttatcatagttcgattgatctttatagtgtaccattactggtaaaagaaattgtaccggattataagtttgccgtcagacatcatgcgactgatctttccggaactgtattgtatgcatggagagaagtttagaaattgggcagatatatagaaacgagattgtgattctatagggggtggataccatatgaagaaaatgcaattactggattgtacgctgcgtgacggagcatatatcgtagatgcgaagttcggagtgccggcgatcaagggaatgatcaagaagttacaggatgccggagtggatattatcgagtgtggatggctgaagaatgcaccacatgaggaaggcacttccttttaccatgtgccggaggatctggaacaatatctgttaaagagaagaacgcatacgacctatgttgcaatgatcgactgggacagatatgacctgtcctatctgccgcagtgtgatggaaagtccttagatgcgatccgggttgttttcccacatggaaagcataaggaaggaattacggtaggaaaagaaattgcaaaaaagggatatcaggtctattttcaggcagcaaatacacttgcctattctgaggaagatttgatcgatcttgcaagagagatgaatcaggtacatccggttgcagtatcggtggttgacacctttggtgcaatgtatcaggaagatttagagcggatcgtacaagtcttagactgtgagctggatgctgggatcaagctgggatttcattctcataataaccagcagctttcctttgcattgacgatgcattttgtcgaactgttgaaggcttctaaaagaggctgtattgtggattctagtctgtgcggcatgggacgtggtgcaggaaatgcaacgacagagttggtcgcaaattacttaaaccgtaagcagcatggtgattatgatatgaatcagattatggatgcgatcgacatgtatatgcagtattttcaggaaaactatacatgggggtattcgacaccgtattttattgcaggaatgtattgctgtcatgtaaataatattgcttatttattgaaaaatcatagaacgaatgcgcttgatatgcgcaatatcattgaatccctgtcaccggaagaacggcggaaatatgattatgatctgctggaggaaaaatatctcgagaatcagaaccggattgtggatgatgatgcggtaatggaacagttagagcatgcactggcaaatcgggaagtagttctcattgcaccaggaaaaaccagcagtacagactggaagcagattacagaatatattcagagaaccaatgccattgtaataggaatcaatgcaattaatccaaattatacttttgactatttgtatctgatgaataccgttcgctataattatgcgaaagaagtatatccaaaacagtttggcgaagtacagaagattttgttatccaatatcaagacgagcccggaagaaaaagaaatgattgtcaattttaaccgtgtgattaagcgcggatgggagcattttgataatgcggtaatcaatgcgcttcggctgctggacaagcttcatgtacagaaagtttctctggctggttttgatggattcaaacacaagtataatgaaagttatgcagatgcggcattgccgacgctcaacccggataataaatgggatgaattaaacgaggaaatcaatgatatgttccagaattttaaggcttcttccaatatgaagattgcttttttgacggaaagtatatttgatcatggagaacagacaatatgaaagtaatcatcttagcaggaggtcttccaagtaccctcatcgaagaggacgaaaagatgccaaaaccgatggcagagattggcggtcggccgatgctctggcacattatgaaacagtatgcgcattatggatacaatgattttatcatttgcaccggatacaaaggagaagtgattaaggattacttcatgaacttttatatctaccagtctgacatcacagtggatttacagaccaatgaagtggaaatacatagaaaacagacagaagactggaaggtttcgattgtggataccggactgcagtcctcggtgatggagcgtctaatcatggtgcgtgaactggcaggagatgagccggttctggtggcttacggagattgtctgtcagacattgacatacaggaaatggtagaaagtcatcgcaggcagcagtcgcttgctacagtggcaattgcacatccgaccggccgaaatgagattcttgcgcttaatgagcagggctgttatactggcacaaagcagggaaaaaagcagaaacattcctgggtaaatgcctgcagtatggtattggaagcacgcgcatttgattatcttaaggaaaatcaggagaatcattttgcattgtcgcttatggattgtctggcagcacatgagccggttcagacgtatcgccacgaaggcttctggtcaccagttgagacaattcgtgacaagacattgatggaaaacttatgggcacagcataaagcaccgtggaaggtgtgggaagattaagcttcatcagggaagatggagacagagagaaccatggagggtaaacaaatgaagtggttggaatattacaaaggaaaaacggtactggtgacgggccacaccggttttaagggaagctggctatgtgtgatgctggagatggcaggcgcaaaagtggttggctatgcgctgccaccggaaaaagatgccgtattatttgattgttccggtgcggcagagcggatggtttctgtagagggagacattcgtgaccgggcacacttgcaggaagtttttcacacgtatcagccgcaggtcgtatttcatctggcggcacagccgattgtgcggacaagctacgagcagccggtatatacatatgagaccaatgtcatggggacagtaaatctgctggaatgcgtgcgaaacaccccaggggtacagtccgttttaaatgtcactacagataaagtatacgaaaataaagaatgggagtgggggtatcgtgagaatgatccgctggatggttttgatccctattccaacagcaagtcctgttccgagctggtgacgcacagttatagaaaatcatttctggatgaaaaaggaattgcggtttcgacggcaagagcaggaaatgtgatcggcggcggagatttttcgcgtgaccgcattattccagactgtgtgagatctgcattgcagggagaagaaattatcatccggaatccatactcgatccggccatttcaacatgtgctggaaccgttggcagcatatatgcagattgcggcggcacaggcaatagagcacgaaaaagcaggatattacaatgtgggaccggaagagtctgactgtgtcacagtaggcacgctggcgagtttattctgcaaggcatggggcgatggtctgaaatggaaaaatgtctgtgaagatggaccacacgaggcaaaatttctgaaactggactgctcacatatcaagtatgcattggactggaaaccgtgttgggatatccgcacggcaatcgaaaaaaccgtggaatggacgcgggtatatgcagcgcatggggatatccgcgcatgcatggagacacagatcaacgaatttttagagatgaccagtgaaaaagggcagatgtgatatgaaagtagtgattttagcagggggcaagggcacccgcatcagcgaagaatcccggctgcgtccaaagccgatggttgagattggcggaaaaccgattttgtggcatattatgcggcagtatgcctcttatggatttaacgagtttatcatatgctgtgggtacaaagggcatatgatcaaggaatactttgtcaattattatcagaataacagccagttggaaattcgcctgaaggatcagcaggtgcaggtcttaaaaaagaacagcgagccatggaaagtgaccatggtggataccggattggaaacacttaccgcagggcgtattttaaaggtgcgcgattacatcggcggggaaccgtttcttctgacttatggcgatggggtgtcagatgtaaacatccgggagcttatcgcatttcacaaaaagcagggaaagacggtgacgatttctacaacacagccggaagggcgtttcggagcattgcgtctggacgataccggcagtcaggtgctcggttttaaagaaaaggcacgtgcggatcaggcgtgggtgaatatcggattcatggtgatggagccgtcagtgtatccgtatctgggcgatggaagtaccatgttagagacgttgccgtttgaacggcttgccgcagatgggcagatggcggcatataagcatatgggcttctggtctccgatggataacattcatgaccgggaatatttacagaagctttgggacagtggaaacgcaccatggaaggtgtaactgccacgaacggaaaggaaaaagtgatgtttgaacataaaacagaggaagaagcacggaaagagattctttccatggtagaaggatattatcgggcgtttcatgcgaaaaaagaagactttagggaaggagaccgcatttcgtatgctgcccgggtatacgatcaggatgagatgtgtaatcttgtggacagtgcgttggaattctggttgacttccggcagatatacagaacagtttgaaaaggaacttgcagattatattggtgtgcgtttttgttcgcttgttaattccggttcttcggcaaatctgctggcgtttatggcgctgacttctccacttttgggagagcggcgtgtgaagcgtggggatgaaatcatcacggttgcggcaggttttccgaccacggttactccatatctgcaatatggtgcagttccggtttttttggatctgacgattccacagtataatctcgatgtgagccagttggaagaggcgttgagtgagaagacaaaggcagttatgattgcacatacgcttggaaatccgtttgacctgaaagcaatccgttcgttctgcgatgcgcatggactctggctgattgaggacaactgcgatgccctcggaagtgagtattgcatggatggagtgtggaggaagacgggaagcatcggtgatatcggtacgtcgagtttttatccgccacatcacatgacgatgggcgaaggcggtgcagtttataccgacaaccctttgttgcataagattatccgttccctgcgcgactgggggcgggactgtatgtgtccgtccggaaaggacaatctgtgtggtcatcgtttcgataagcagtatggggaacttccactgggatatgatcacaagtatgtatactctcattttggctataatttaaaggcaacggatttgcaggcagcgatcggatgtgcacagcttaagaaactgccacagtttgtagaacgtcggcgggaaaattttgagcggctgaaagcgcagttatcagcagtagaggaccgactgattctgccggaagcctgtccggattcaaagccatcgtggtttggttttctcattacctgccgcgaaggtgtggataaaaatcatgtggtacagtatctggaatcccatggtgtacagacacgcatgctgttttccggtaatctgatcaagcagccttgttttgatgagatgcgtaagagccatgaaggttatcgtgtggtcggggatctgcatgtgacggatcatattatggagaacagtttctggatcggggtgtatccggggatgacggatgcgaagctggattatatggcgaaggttttatgtgaggcagttcgggggtaagaaatatgaaaccacaaatcattctcgctggctccggcggctgcatgcgtgaactcgcatggcagatgccggactggcagatttcaggatatgtagatataactccaccggaacatcccgtcacaatagggaaccgaatcattccttatctcggaaatgatgactttctgttgcaacagacaagagatattaacgttgcaattgcagtgggagatcctgcgcttcgacaaaagattgcacagaaattacaaacgaatccccacattcatttcccgaacctcattctccacggagcagaggtctgttcagacgtaaaactgggccagggctgtatcatcagcatggatgcaagagtatccaccaatgtccggatgggagattttgtatttttaaatattggagcaatggtttgccacgatggcagattgggagattttgtcacgctggcaccggatgtgaagctggcaggtgcagtacacattggaagccactgtgacattggtcttggcacaaaggtgattcagggaattacgattgcggatcatgtgcgtaccggtgcaggagccgttgttgtgcgggatgtgggggaagcaggtacggttgttggtgttccagcgcgaaagataaaataaacatcgacttttcaatgagctatggataggttataatattcatagctttttgtttttagaaattttttaaatggggttcgtatgaaagaagaaaaagagacagtatatgatgaggcaatagagactgcaaaagagatagaagtagtagagaatgtgatgatccagacggcaacaacacaattgtcgtttagttcgctgatgttcggtctggaaagaggcgattatgtgatcccggattttcagagaatgtatcattggacagaagaacaggcagagcagcttgcgatttctctggttcggggaatgccgattccgcctatttatggttaccgaaatgcagaacagcaggtggttattttagacggacaacagagggtcctgagtctgtatttttattatattgggaaatttttaggaaagaaaagaaatgcatttattgatgtcagaaaagcaaacgatggatcaataaaatttcgggattacctggaaagctgtgatttaaaagaaaagaagtatcagatggagtctgaggggaaaaatggaaagacgcagatcattgatattacctatcaaaacatcagtgaccgggtaaaacgcaagatcgatttttctccaattacattggtggaaattaatgtagatagtaaagaatacaaagaaagaaccttacataaaatatttgcaaatttaaatattggtggaactccattgtcaagtcaggaactgagaaatggaatttatggctgtaaattttatgaaatgttgtatgacattaatgataactcaaaaaaatggagaattttatataataataaaataacagaagtgaataaagaaagcaaagatgttgagacacttttgagaatgtgtgcgtttgattattatataaaaggaaccgataaccagtttgaattgacgggatacaaaggaaaaatttctacattgttagactctttttcagaacgggcaagagagtttagtgacaatcaaattgaaggatatcgattaaaattattggaatttatagattcgattgaaaaagtcagtgggaaaaataagggagtagcattggcaagtttctttgttgcatggaatcggctgaaagaaaagccgtttatcaccagggaaaaatatgatgcgattgttggaagtgatgcatataaggagacgaacaatagtggaacctcggcaagatctgaaatagaaaaaaggataaggtgtgtatatgaacagttatcacaaaatggttaatcgcgtcacagaaatgatatgtgagcatatcgatgacacggagaattttattttaattggtgacaattcatcaggaaaatctgaaatactgcgtacaatcattgagaaaaaaaagggagaagcagtttattatatagattcagtaaacagaacctttgatgcaggaaaagtagaactttttagtgaaaagtataaagagataaaaccggattttcaagggattacatccgtcagagttcatccgtttaattttaatttgcaggatacatttgcagcagcatcccgcatagaacatttatatgttaaatatcgcaggcagattgaaaaattttgtgaatcgtttttagataaaaagttcactatagaacgcgaagatgatggggtcggaaatccggaaaatgttgttaagatcaatggagagataatgacgctttccagtggttatcaggcacttattcgcattttttgtgaaatattgtttttttcagactgtatgaaagtgcagagactggaaaaaggaattgtggttattgatgaaatagatgagtatttgtcaccaaagtatagtgcggaaattttaaatttccttcatgatgaattttcaaatattcattttatagtaacaacacattcacttgatctggttgaaaccaccgaaaatgcaacgattattgtgataaacaaatgtacgtatgctacctataccagcgaatttctgagagacacggtttcggcaaatgatatttttacgaatctcttttttgaaaatcgaaaacttcatgtgtctgataatgacgatatggataatcaattacgtcagtatttgaacagtaaagttgcaggtatgtgggatgaaaaaatgcaggaagagttggaacaaattaatttggaggatttgaaaccacatcagagattgattttcaaacagattaaggagtggtaaaatggaggatttctttgtggtagatattcctgtatttgtgccagagtacgacaaggataaaaaatatgggtggacaaattataaagatgaattgtgggatttactaaaagaaacaactcatggctattgtatgtattgttatgatcgcatttggatcaatcaagaaagacgcggacagatcgaacatggaatagaaaaaaagaattcaatgaaacgtttacaggattgtgtgccaaatctcggaatttcctgcgaaaattgcaatcagaaatacaagaagcgaggggaacagaagagaagactttcacaggaacagatatgtgaatttgaaaagggagaatgtacatcatttgaatgtaaagagatgtgtacttcttttcgaaaaatacgaagagcatatgtaaaacagggaaagattatgattcaaccatttgaaacaaaactggaagaaaacggaaatgttttaagaattcagtatgatttattacaatgtaaatatattcccatgaaatcatatcattacactgagcaggaattagaagttataaggaaacatatagagttatttgcgttgaacagtccggaaagaaaaaattatgagatcgcgaaatattgtaaaaatgtgatagataatagatctttaatgcttgggatagattataataatcttattgtagatctgtttagagaaaagctagtgagtttacatgaactggaaaaagcaatcaagctgtgcaaaacgatatattgtatggcagatttaaaagaaagtacataaaggcaggtacaaaacatgcacacaacaatcatcgcagaagcaggtgtcaaccacaacggcagcatgacacttgcgaagcaaatggtagaaaaagcaaaacaggcaggagccgattacgtaaaatttcagacattcgttccggaaaagctggtctcccgtttcgcccagaaagcagaatatcagaaggaaacgaccggagcggcagagtcgcagcttcagatgttacagaagctggcactgacacaggaggattttatagaactacaggcgtattgtaaaacagtcgggatcggctttttgtctacaccgtttgatctggacagcattgcatttttggaaaaactggatatggatttctggaagcttccttccggcgaaatcacaaatctgccatatctggaagcaatcggccgaacaggaagagatattgttatgtctaccggcatgtgtaatatgcaggaaattcaggatgcaatttccattttggagaaaagtggagcagggaagattatcgtgttgcattgcaatacggaatacccgacaccctatacggatgtgaatctgcttgccatgcagcagatgcgtcaaacgttacagaaaccggttggatactcagatcatacgatcggtattgaagtaccaatcgctgcagttgctttgggggcaacggtcatcgagaaacattttacgctggacaagcagatggaggggccggatcaccgggcaagtctggagccacaggaactggcgcagatggtagccgcaatccggaacattgagcagagtcttggcaatggaaagaaaaagcgcacagcatcggaagaaaaaaactgcgcagtagtaagaaagagcattgttgctaaacaggtaattaaacagggagaactttttacagaggaaaatctgacagttaaacggccggggacaggaattaatcctatgcggtggcatgagataattggaaaaattgccgatagacagtatgatgtggatgaatgtattgaggatgtaaaatgaaaaatatagggatattaacaggaacaagagcggagtatggtttattaaaaccagtgatgcagaaggttgagcaggataaagatttaaatttatgtctgatagttacagggatgcatttatcggaacaatttgggtatacatatcgtgaaattgaaaaagatggatttagaattgactataaaaatgatatggaacttgtgtcagatacatcctatgcaatatgtaaatccatgggaaaagaattagctggatttgcggatatatttgaagaggctgatctggatatgctagtattattgggagatcgttttgaaattcagatggcagcagtagcggcaatgctgtatcgtataccagttgcacatatccatggaggcgaattgacgcagggactgatggatgatgcgattcgtcattctgtgacaaaaatgagtgatttacattttacaagtacaagtgaatatgcacaaagagtaattcagatgggagaacagccagagagggtattttgtgtgggggcattgggaattgaaaatatcaaaagtattcgacttttgtcaagagaacaactgtgtcaaaagtttggagatatttttttgcataactatattatggttacctatcatccggttactttggaaaaacacacggcaggaatccagtttcaaaaactattaaatgtggtggaaaatcacccggaataccattatatttttacatatgcaaatgcagacacagatggggcgattattaataaaatgattgaatcttatacacaggaacataaaaatacaaaagcttttgtttctatgggacaattgggatatttaagtgcgctccagtattgtagtgcagtattgggaaattcatcaagtggtattattgaagcaccatcatttcatattccgacgataaatataggggatcgtcaaaagggacgtgtcagggcaaagacggttattgattgtggttatgaaacaagggatattgagcaggcactcacagaatcacagaatcagaagtttaaggatttatgtcaggagagtacaaatccatatgaggggaaaaatacatcggaacaaattatcatgcaaataaaaaaatacttaaatcaggtacagggaaaacaaaagatattttatgatatagaggtgtagtgtgaagattttatatattggatgtgtggaatcatcgtatttattattagaaaaattgatcgaagctggtgcagatattgttggtgtaattacaaaaaaggaatcaaattataattcggattttagagatttagttccgctatgcgaaaaaaaagaaattccatatgaattagtggaaaatataaacgaagaaaaagtttataagtttatagagaatatacaaccagaaattgccttctgtttcggttggtcacagttgattaaagatgatattattcaaaaaattccacagggaattataggatttcatccggctgcattgccaaaaaataggggacgccatccgattatatgggcattggtgttggggttacaggaaacagcctctacatttttcatgatagatgcctcagcagatactggagatattgtatcacaaaaaatagttaagatttcgtacgaagatgatgcagcaacattgtatcagaagattatgacgattgcttgtgagcaagtagttgaattatgggagcagttgcagaatgggactgcaaataaaattaagcaggatgtaatagagggaaattcgtggagaaagcggtcgaaaaaagatggtgaaattgactggcgtatgtcaggacggagcatttataatttagtcagaggcttaacaaaaccttatgtaggagcgcattttgtacatcagggaaaagagataaaagtttggaaagtatgtgaaatagataccgataagtatgagaatatagagccaggaaaaatattagacatttatgaaaatggagatattgacataaaaaccggagataatgtgattcgactaattgaatatgaatctgtagaactaaaatgtggagaatatttgtaagaaagggaaaaatatgaaggtgatggttgtgtctccgcatccagatgatgagacattaggagctggaggaactttattaagattaaaaaaggaaggacatcaaatttattggctaaacataacagatgcaaaagaaaaagatggatggagtgcatcatttataaagcagcgaaaagagcaaatacagagagtgtgtgatttttttgaatttgatgatacatttaatttgaaatttccaccagcaaagttggaaatgctggaaaagagcatattaattcagaaaattggaagctgttttcagactgtcgagccggaatggattattttaccagacccaaatgatgcacattcagatcataaaattacatatgaaagttgcatatcgtgttcaaaaatttttcggtatccctatattcacagaattacaacaatggaaattttgtcagagacagattttggtcggatagataatccgtttgttccaaattattttgtaaatatatcagattatatgaaaagtaaaatacaggcattggaaatatatgatacagaattaggagaacatccatttccaagaagtgtagatagtgtaaaagcattgggcactttacggggtgcttgtgcaggagtaaaatatgcagaggcgtttcgtataattaaatggatagaataggagtgcaaatgaaacatctggcagtaatcaccgcacgcagcggttcaaaaggattaaaagacaaaaatattaaattactcaaagggaaaccgcttctggtctactccatcgaggcagccagacagtctggaaaatttgactgcattcatgtctcgaccgacagcgaaaaatatgcacagattgcgcgggagcatggagcggatgtgccgtttttgcgtgatgcggcacttgccacggacactgccggaacctgggatgtgttaagagcagttgtgcagcagtatgccgcaatcgggcagcagtttgacaccatcactctgttgcagccgacctccccgcttcgcgatgcggcagatatcaaaatggcatttgagatttttgaagagaaaaacgcacagtcggtggtcagtgtctgtgaagcagaacattcaccactgctttgcaatacattaaaagaagatcagtccatgtgtggatttgttgatttacagaaagttggccggcggcaggatatgggaacatattaccggttgaacggtgccatttatctgcagaccacggaacttctgatgagtcagggagatctgtacggagaacattcctatgcctgcgtgatgagtcaggaacattccatcgacatcgacactgcactggatttccagatcgcggagacaattatgagggcatcctcttaacattttttcacactggtcgatatatataacaggtctatcatggaagatagaaaaagagaacgttttcttggagaaaacgaaagaagaaacatggaggttcccatatgaagacagagcagttagcgttatttttaatatccccggacagtacggttgtggaagcgatgcagcgcatcgaccgtaatgccaggggtattttatttgtgaccaatgagcagcagaaactgcttggtgttgtcacggatggagatatccgccgctggctgatccgcacgggagaactgaaagctccggtatccggtctgatgaataccgaacctaagagaatttccaggaaagagcatgcaaaagcacatgaggttatggtgcagcattccatcacggcgcttccggttgtcaccacaaaaggcgtggtatctgacattttgttccgggatgagcaggtggcaaaaaagaaaaagccgcaggggattttaaaagaggttccggtcgtgattatggcgggcggaaaagggacacgtttatatccgtataccaaaattcttccgaaaccgctgatcccgattggagatatcccgatcatggagcggatcatcgggaaattctgtgagtttggaacgacacagttttatgcgacagtcaattaccgcaaaaatatgattcgctcctatttctccgagatttcaaaaaactattctcttgaatatgtcgaggaggataaaccacttggcacagcgggaagtttacagttgatcaaagaggagttttcccggccgtttattgtgaccaactgtgacattttgattcatgcggattatgaagatatttaccgctatcataaagaggcgggaaatgaacttacgattgtcacggcactcaaaaatatcgaagttccgtatggggttattcattccagtgaaaacggagccgtccagtccatggaagaaaagccgaaactttcgtattttgttaataccggcatgtacattttaaatccggcactgaaaaaagagatcccggaggatactttttttcatatgacggatctggcagacaagcttttggcagaaaaccgccgggtgggaatgtatccgatcagcgaggattccttcctggatatgggtgagtttgaggaaatgcaccgtatggaagaaaaactgaatttgaaatctgagtaataattggaaacggaaaggacatatagagcaatgaaaaaagtattagtaaccggagcagacggttttattggaagccatctgaccgagagtcttctggaaaaaggctatgacgtaaaagcatttgtatattacaattcgttcaacaactggggctggctggatacactgccaaaggaaaaacttgaccagattgaaatttttgccggggatgtgcgggatccgaacggtgtgcgcactgcgatgaagggtgtggatcaggtctttcatctggcagcattgattgcgattccgttcagttatcattcgccggattcctatgtggatacaaacatcaagggaacgttaaatgtgctgcaggcggcacgcgatcttggcacggaaaaaatcatggtgacatcgacttcggaagtatatggcaccgcacaatatgtcccgattgacgaaaagcatccatttcagggacagtctccgtattccgcgacaaaaatcggagcagatcgtctggcagaaagcttttaccgcagctttaatcttccggttgcaattgtccgtccgttcaacacttatggtccaagacagtctgcgcgtgcagtgattccaacgattatttcacagcttctggcaggaaaagaggagattaaacttggttccctgacaccaacgcgcgattttaactacgtaaaagataccgcggcaggctttattgcaatcgcagagtcagacaagacaattggacaggaaatcaatattgctacccaacaggagatttcgatcggagatctggcacaggagattatttcccaggtcaatccgaatgcacatattgtgtgtgacgagcagcgccttcgaccggaaaagagtgaggtcaaccgtttgctcggctgcaacgcaaaaatcaaggagctgaccgactggaagcagcagtatacattcgagcagggaattgcagagacgattgcatggattcgtcagcatatggatgtatataagacagacatttataatgtgtaagttgtaattttaagaaaagagggagcaaaatgggacgatttgtacctttatcgattccgaattttgagggaaatgagcgaaaatatgtagatgatgcactggatcagggatgggtttccaccggtggtgcatacatcacagagctggaagaaaaactggcagagtttttacaggtgaagaaaacagcggcagtgcagagcggaacttcggctcttcatctgtctttgattgtttgtggggtgcagccgggagatatggtgattgttccaacgcttacctttatcgcggcagtgaatccggtgcgctatcagttcgcggagccggtgtttatggactgtgatgacagtttgtgcatggatccgcagaaactgcgccgtttctgcgaaaatgagtgtgtgacagaggacggacagttaaagcataaagctaccggaaagaccgtaaaagccatcgtagttgtgcatgtgtttggaaatatggcagatatggaagccatcatggatatcgcacaggagtttcacctgaaagtgatcgaggatgcgacagaagcactcggtacacaatatacgaaggggcgttatgccggaaaatttgccggaactattggcgattttggggcgtattcttttaatggaaacaagattattacaaccggtggcggcggtgctgtgacagcaaaagatcccacagaagtggagcatctgaaatatctttccacacaggcaaaggatgatccgcatttttatattcacaacgaagtgggatacaattaccgcatgacgaatttacaggcggcacttggtgtggcacagatggaggaacttccggaatttatccaccgtaagcagaaaaattatgggctatatcaacaattgctgcaggagttttcaggtggaacactgctttcatttcgtgaggggacttcctcgaaccagtggttttattctttgaagctggatatggaaaaactacagggaaaaaacatgagagatgtgattacaacgcttcaggagcgcggtgtgcagacccgggcgatctggggactgattcatgagcagcttccgtatcaggatgcgattgcttatgagatggaaaaagcaccgtactatagcagttgtattttaaatattccaagcagcacacagatcacagatgatgatattggctttgtggtggaacaaataaaagtggtatttaaatctggaatttgaacagatcaggtgacattcacaagtatttgttcgggtcaataagctgtgtatagggtattttataaaacaataaatggatgttggggtcaaaacataatgtctcgaaaaatcaagcatttccggtactttttattgcctttggctgctcgatttcaagacctgacataagccagtcaaactgcctccatgtaatgggttttacctcattacggttgcgcggccaacggtattttcctacgttgacatcaagtcgcttatataaaagtacaaatccttcacgttcatgaagaagcacttttattcgatcactacgtctgccacagaagagatagattgcatttggcctggaagggttcatattcagctggtcttttacgacagcgcataatccatcaatggacttgcgcatatctgtataaccacagatcacataaatctcgtctgcgacagtgatgtctcctaacatgtccctgtcacagctttaaggatctgtgacagcagcttcgggtcaacatcatttgaaatttttattgaaacagtcccaagcatgacctcgatggcggggcagggttcttccagtggaagcattgtgctttcgacagttggaatgcccgggttttgatgatcaggtatcacctcaagttttacaacatccggtttaagggctggcttataatcgccgcgtcctgtggcagaggggatatcataacaagctttttttctcagtcttttaacccagttgtaaaaggtgccgggattgatgttatgttctgtacaccattggtagtcactaagaccgctgctgcggcattccatgataagttgatattgttcgtctgctgtgcgtctttgcgttttcatacaagaaaacctccatagttatagtaaaacgctcgcatttatagtatctagcgccgatactgtagtaaaatgctggcatctatcatctataattatggcaaattttgtgatgattttaaatccaccctgaaactaggcgcttacgaaagaacgaaagaaaaaagcgagacgtaatattgaactcctgaatcaggaactgcaggggctgacacagtctgttctgggcgaaaccgggcagaaggattgtctcacaaagattgtagattgtatgaaagcgaatgattcattggcggcaaagtttcaggaggatacccgcattccgtatgttttgtatcagttggcaaaaagttattatatggctgcggagtatacgaaggcatgtgcttattttgactgtggattgtattttgatctgaatccaagactggaatatgtgatcgatatggtagagacatatggttatgcattactgaattcgggacaggcggatcatgcactgtttctggaaaatgtttatgaggaatttggaaatactgcagattttaacttcctgatgggactcatttatatgaacaatgaaatgtttgacgctgcagtggaagaatttaaaaaggcgttaaagatgccggaggaacgtgccaggggagttaattcttatcttgcctgctataatattggtgtgatctacgagtgtctggggcagatgacagaggccgagcagtattacaacagatgtgggggatatgagcctgcagagaaaagattagaaaatatgaaaaaataaatactatttacaaatatcctcccacagacgtataatagaaatacgcctaaaggaggatttttttattgaaaaagcaattatttcatggatcggatcatataattgaaactccgatatatggagttggaaaaaaacacaatgattatggacagggcttctactgtaccgaagatattgccttggcaaaggaatgggcggtatcggaggaaaaagacggatatgttaatgaatatgagatagagacaaatggcctgcatattttaaatataaatgatggcagctttaccttgttacactggatggggcttttgttgaataaccgcgcgtttatattggcaacaccgctggaaagggaggcaaaacggtacattaccgattgttttccagttccattagcaggagtggatgtaattataggatatcgtgcagatgacagttatttttcttatgcaagggatttcatcagcggtgttatatcgtacgagcaattagggaaagctatgcagttgggaagccttggagagcagtactgccttaaaacggaaaaggcatttcagcatcttaaatttatagcgaaagaacacgtcccttctgccgagtggtattcgaaaaagatgttgcgggatcggaatgccagaaacggatataaggacatggaaaaggaaacctatcacaggggggaattgtatatttccagaatcattgacgaggagatgaaaagcgatgatttattcttacgataaagtatatttaagaattgcacagcgtgtactgggcgagatgctcaattatgccgtatatgattgtggatatgagttgaacgagtattatcggctttttacagaatcttcatacagtgagcgtttttcaaaaggagactcatttgtaattgcgggaatgtcaggggcagagctggccattcgtgtgatggatgtgccggatgacgaaattgttgcgccgggatattattttgaaaaaagcccggaatattggaccggatggttgttggcatattatcaatggatgagtgggaaaacctttgcggtgatacaaaaagaagtcccagttgagaaaattcgtgatttatatcatccatatcatgagatggatattacgcagggagtgcaaaaattaagagagattgctcagcagaacagggtagaaagttatctgaagttgttacggaaaagagccagactcagtcagagccagcttgcggaggaaacagggattcccgtcaagacgattcagcagtatgaacaacggaggaaagacattaacaaagcgcaggcggagtatgttattaaactttcgcaggtgttgtgttgcaaacctcaggaactgatggagataaatgaatgaaaagcctgcttttcattcatttaaggatagggtatactatatgaaaaaggcaaagacagggggtgactgcaaatgtctgaaaacatagcaatcggaatacaggacttctccacattaattgaaaatcattatttttatgttgataaaacggattttataaaggaatggtgggactgtggggacagtgttactctgatcacaagaccaagacgttttggtaaaactttgaccatgagtatggtagaacagttcttttccgtggaatattccggacgttcggatctgtttgaggatttaaaaatctgggaggataagaagtaccgtaatatacagggaacgtatccggtcattagcctgtcttttgcaaatgtgaaggaacccacgtatcagctggcagaaaaaaagatctgtgaattaattgcgcagctttatgtcaaatacgattttataacggaaagtggaaagctacgggatacggaagtaaagttgtataaaaaaatcatgactgatatggagtatgtagatgcaacactttctttatattatctgtcaggatttttgtataaatattacggtaaaaaagtaattattctgttagatgaatatgacacgccaatgcaggaagcttttgtagatggatactgggagcagcttgtgacattcacaagaagtctgtttaacgcgacatttaagaccaatccggcattagagcgtggaattatgacaggaattacgagggtcagtaaggaatccattttttcagacctgaataatttaaaagtggttactacaacatccaatgaatatgctgcatcctttggttttacggagcaggaagtgttttctgcactagaaagtttcggactggaaaacgaaaaaaatgaggtaaaaagatggtatgacggatttatttttggaacccacaaagatatctataatccgtggtcgattttaaattatctggatgcaaagcagtatacaacctattgggcaaacacaagcgcaaatagtcttgtcggaaaattggttcgtgaaggaaaccgcctgattaaagaaaaatttgaaaaactattatgtggggaatgtatctggtcggaaatagatgaacagattgtatataatcaactggatggcaatgaaagggcggtatggagccttttactcgcaggcggatatttaaaggttttgtcttatgaaaaatatcaggatattccggaaggaacggaaccgaaatatcagcttgcacttaccaatcttgaagtaaagcttatgtttcagagaatgattcacgattggtttgccccggtacagccggattacaacgattttgttaaggcaatggttgctggggatgtggatgcgatgaatgaatatatgaaccgtattgcattacagacattcagctattttgataccggagaccgggcttccggggctgaaccggaacgtttttatcacgggtttgttttaggtctgctggttgatttgcgggacaggtattatctaaggtcgaatcgggaaagcggctttggcagatatgatattatgttggagccaaaacatccgggaaaggataatgctgtgattctggaatttaaagtacgaagcgcaagaaagggaaaaagtctcgaagagaccgcgcagtctgcaattgcacagatcagggaacgaaaatacagtgaagaactgaaaatgaaagggattacagatagtcagatcaaagaatatggagttgcgtttgaaggcaagaccgtgttgattgtggattgagctggaggaaaaaacaatgggaatctatgtaaatccgggaaatgaagaattcaaaagagcagcaaattcaaaaatatatgtagacaagaccatgctcctcgcgtttacaaaccagaatttaaaatcagagcatcaaaacatctgtgtcagccgtccccgccgcttcgggaaatccatggcagccaacatgctgtctgcctattatggcgcggaaaatgattcacatgcattgtttaaaccttacaggattagcaaagacagtagctttgaggagcatataaataaatacaatgtcatccagattaacatgattgatttcatgacacgcacttcttctgtcgaagaaatgatagattatctgcaacgtcggattctttgggatttaaagaaagcatacagacaattagaatgttttgactggaatgatctggtggaagtattgcagaccatttatgcggaaacgaaacgcgcatttgtaatcattattgatgaatgggattgtattttccgcaaatacccggataaccatgaggatcatatccggtatctggatttccttcgtttctggctcaagggaaaatcatacattgcattagcctacatgactggcatcctcccaattaaaaaatacggcgaacattccgccctgaacatgtttgatgaatactccatgaccaaccagcgcgaactggcagagtttaccggttttacagaggccgaggtgcaggaactctgtcgccagtacgacatgccatacgacaagacgaaacagtggtatgatggctatgatttaaagggcgtgcagatttacaatccacgttctgtggtcatgtcaatgcttggtcatgactatgacagctactggacaaaaacagagacgtatgaggcattaaagaaatacattcagatgaaccagtatgggttaaaagaactgaccacccggctgattgcgggggaacacatcccggtaaatcctgataaattccaaaatgacatgacaacgtttgccagtgcagacgatgtactcacgttgttgattcatctgggatatctgacatatgatttttatgcacagactgtttgcatcccaaatcaggaagtgcagaaagagtttattaactgtatcgaggacggcggctgggaaccggtgatggcagctatttggcagtcagaggatttgatggaagctacacttcgtggtgatgaagaatatgttgcacaacaaattcagcgggtgcatgaagagaatatttccattctgaaatataatgatgaaaattcactggcgtgtgtactgtcactggcatactatgcggcaaagaaaacatatgaagtttatcgggaattagcaggtggaaaagggtttgcggatctggtgtttgttccgagaaagaatgtcgaaagtcctgctatgattgtggaattaaaatgggatcagtctgcacagacagcgcttgatcagatccgggagaaaaagtatgacaaggcattaaaggactatcatggaaggttgcttctggtcggaattaattacaggaagtcggaaaaaacttatacctgcaagatagaaacggagacgatagaaaaatgaaccagtatatatttaccccaaccggattttacccggacacacaggaaaaagaaactttggagaagcgctacgaaactttatatcacatgggattttccaagcggtcaaaagaaatgtcttcatcggagctgtttttatatgaactgtcagagacatttttccggtgtcttacagaaatgccggaactggagctgacaagagaagcgacacatgtggtgccggatgaggaacatctcgagcatctgctttcgtcagttccttatgcgattggggcagaatatattgaccgtaagtggattgccggagtattttcgcagctggagcagatttttcagagggaaatttcaggctataaaggcagtgtggaattgtatctcacagagcagaaccagaagctgcatgtaccggagaggatctttctgcatctggtagaaaataaagatggcgaagatccgtttgtttttatggcaacctatgcttcgctcggagaggatcatgccgtgcatcatatgccgctgaaatacgcgctgaccgaataccaggatgacagagataagctgctggcattgttgtcctgcctgaaccgtgcggcagaggtatcggatctgattgcagaactggtagaaagtggggagatgtttcatgttctgcgttttacagggaaagaggcatatcagtttctgcgtgatgtggaaaaaatcgaacagaccgggattctctgccggattccgacctggtggagaaagcgtgcaatggagtgttcggtagaaatacggctgggcgaaaagaaacctgccatggtaggatttgattcgttgatttcgatgcagccacagctgtgtgtggacggagaggcacttacgaaaaaagatgtggaacttctgctggcgcagacggaggggctggcatttttaaaaggcaagtgggtagaggtaaatcataaaaaactgcgggaacttctgaaacgtatggatggcatggacaccagcattacactgcgggaagctttgcagatggaaatcggaaatggaaaaaagatttctgcagatgtaggtgcgcttgtgaccaacggggcatggctttccaaaatgttgcgcaatttgcgaaaaccatccggtatccgttcggcagcagtgccgaaaaccgttcatgcaacgcttcgtccatatcagaaggatgggtatacgtggctgaattatatgcagaaactgggatttggtgcatgcctggcagacgatatgggacttggaaaaacgcttcaggttctctgctatctcgaaaagatgagaaaatcagacaaaggcgcaaaaacgcttttggtcgttccggcatccctgatcggaaactggcagaaggaggcagcaaagtttgtcccggatatgacgcttcaggttattcacggaaagacatctgcgcagcttgcacaggaatttgatgcagggtctgcattccttacgataacgacatatggcatggtttcccgcatcaaggcatttcaggaaacgatgtgggactgtgtgattctcgatgaggcacaggcaatcaaaaatccgggcacgaaacagacacgcgaaatcaaaaaactgcaggcacagatgcggattgccatgaccggtacgccgattgaaaatgacctgaccaatttatggtcgttgtttgattttatagatcatggtctgcttggtacatccaaagagttccatgagtttacgaaaggactggaagaaaatccacaggaatatgcaaaattaaagtccatgattaccccgtttatgctccgtcgtgtcaagacggacaagaccgttattgcagatcttccggaaaaggtggaaatgacagattttgcgcagctgaccagaaaacagaccattttgtaccgcaaggtggtttcggatatggagcagaaagtccggcagatggaggcagaacacagcatttcccagtttgccaaaaaggggattgtgcttacagcaatcatgaagttaaaacagatctgcaaccatccggaccagtatctgggacaggatgtttatacaccatcagagagtggaaaatttcagcttttgaaagaaatctgtgagacaatctatgaaaagcgtgagcgcgtgctggtttttacgcagtttaaggagattgcggacgatctggcagcgtatctggagaccgtttttcatgctaagggctatgtgctgcacggaggaacaccggtggcgaagcggacggaaattgtggatgcctttcagggagaagcctatgtaccgtttattgtgctgtcggtaaaggcagccggaaccggactgaacctgacgaaagcaaaccatgtcattcattttgaccgctggtggaatccggcagtagaaaatcaggcaacggaccgggcattccggatcgggcagaaaaaagatgtgatcgtacataaatttgtctctcagggaacgattgaggaaaaaatagatgcgatgctggaatcgaaaaaggaactggcggaaaacgtaatcggaagcggctccgaaaagtggattacggagttaagtaacgaagaattgttctcattattgcgattggagtaaacggtatgcgaagatattgggaaattgatcagacatttgcccagccgagtgaatctctgttaaagaaaaatttaaaagagagcgtaaaaaagcaaaaagaaaagggaaataagctggagccggttgttatttccggcagggcaattgcaaaaagctggtggggaaaagcctggtgtgacaatctggagcactatgcggattttgcaagccggctggagcgtgggaagcgttatgtgcggaccggaacagtaatcgacctgaaaatccagaaaggaaaaatcattgcaagagtgcagggaaccagaaaaactccttaccgtgtggaaatccgtatcagtccgctcacagagcagaagtgtgaggcaattcttgaccggtgcggtaagattgagactctggaacgattactgtccggtgatttcccggatgagatgaaagaactgtttcagggagaggatggtctttttccacagccaagtgagatcagttttcagtgcagctgcccggactgggcactgatgtgcaaacatgtggcagcagcactttacggtgtgggggcacggctagacatgaatccggcattgttttttgaattgcgtggaatcgagatcggacggtttgtggatgtggcacttgccaatcgtgtggaacggatgcttgagaatgcacagaaaccaagtgcaagaattatggatgatgaagaggcggcacaaaaactgtttggcgtatttgggagggcatagcaatgggaatctatgtaaatccgggaaatgaagaattcaaaagagcagcaaattcaaaaatatatgtagataagaccatgctcctcgcgtttacaaaccagaatttaaaatcggagcatcaaaacatctgtgtcagccgtccccgccgtttcgggaaatccatggcggcaaatatgctggtggcatattatggaaaaggggatgattcctatgaattgtttaaatcctttaaatttgcaaaagatcctgattttaaaaagcatctgaatcaatacaatgcgattcatctgaatatgcagcagtttctggggcgtacagaatccgtagaggatatgatggaactgatttccagaaaagtagtgagggaactgaaaagggagttcccacaggtcacatattatgaggaggatctggtatcggttctggaagaaatctattcccagacgcggagttattttgttttcgtgattgatgaatgggattgtattttccgggtgaacccgatggatgcgcaggcgcagaaaaagtatctcaattttctcagggatttgctgaaaaatcagccttactgtgtgcttgcctacatgaccggcatccttcccatcaaaaaatacggcgaacattccgccctgaatatgtttgatgaatattccatgaccaaccagcgcgaactggcagagtttaccggttttacagaggccgaggtgcaggaactctgccgccagtatgacatgccatacgacaagacgaaacagtggtatgatggctatgatttaaagggcgtgcagatttacaatccgcgttctgtagtcatgtcaatgcttggtcatgactacgacagctactggacaaaaacagagacatatgaggcattaaagaaatacatccagatgaaccagtatgggttaaaagaactgaccacccggctgattgccggggaacacatccaggtaaatccggataaattccagaatgacatgacaacgtttgccagtgcagacgatgtactgacattgttggttcatctgggatatctgacatacgatttttacgcacagaccgtctgcatccccaatcaggaagtgcagaaagagtttattaattgtattgaggacggaggctgggaaccggtgatggcggccatccggcagtcggaagatttgatggaagctacacttcgtggggatgaagaatatgttgcacaacaaattcagcaggtgcatgaagagaatatttccattctgaaatataatgatgaaaattccctggcgtgtgtactgtcactggcatactatgcggcaaagaaaacgcatgagatttaccgggaattagcaggcggaaaagggtttgcagatctggtgtttgttccgagaaagcatgtcgaaagtcctgctatgattgttgaattaaagtgggatcagtctgcacagacagcacttgatcagatccgggagaaaaagtatgacaagacattaaaaggataccatggaagcatgcttctggtcggaattaattacaggaaagccgaaaaaacttatacctgcaggatagaaacagagacgataaacgaatgatctggtaaatattgtctggttggtgcgcctgaagggcatagcaagggatactacaccagcatcccaagcgttcccgccacaatcagtaccagccccccggcttctttttttccaagtttctcatgaaatacaagataagaaaacagaatggtaaccagaatactcagcttatcgatcggcacaacgacacttgccagaccatcctgcaatgcgcggtaatagcacagccaggaagcaccggtggcaagaccggacaggcagataaagccaagttccctgtgatcaatcgtgcgcacgctgtcctgctttttcgtgacaaacacgacaatccatgccatgatcagcacgacgatggtacggatggcagttcccagattggaatcaatgtcttcaatgccgacttttcccagaatagaagtcaggctggcaaagacggcagagccaagcgcgtagaagaaccagctccagccttttttcccggaattctcagaagaagttccctttttcgtgatcatcaggtaggttcccgcgccgatcagcaccacgcatagaagtttcagtgggctgatgctctcatgcaggaagagaaaagcgagaagaatggagaggatggcactcgatttatcgacagacaccaccttatccacatctccgatctgcagtgcacggaagtagcacagccaggaagcaccggtggcaagtccggacaggatcagaaatgtccaggttttggcagaaacacttccgatgccgtgttgtgccccgaccagaaataccatgatccatgaaaaaataagtacaataatggtacggatcgccgtagctacattggaatcggtatttttgataccgcatttcgccagtatggaagtcagtccggcgaacagagctgacccaaatgcaaatagaatccacatatgcaatttcctccctgggacaagcgtaaaatgttttggggcatttgtcaaaacttttttcttgtgatatgataattttatctttttcagaggtgacagaatgtttgaaaaaaaacagatcatatacagtgaaacacagggagtctgtcaggtagaaaatattgtttcgctctccgcatcacgcagggagcgcaaaattccgtactatgtgctgcgtccggtattcgacaaatccagagtatcttatattccggtagaaaaccatcaggtaaaactgcgggaattgtttaccagggaagaggcagaggcacttcagggaacggaagaaatgaaaaaagacgaaaaactgagacaggccgtggagtatgtattaggaaaaaaggagggataggatggcacagcagcagccacagcaggcaatacataaatttgtacttggaaataaagaacttgaaggaaagacagcggaattccagtatgacaaaggctggtacagcattacggatattgtaggggaggaacgcaatgtaatctacaaatcccgcaatgcgcaggaagcctatatgaaatggaatgtatatatcggccgcaaaaaagagagaccgtcatccgccaaaaacagcgatgcggatcatggaagccgtgcggatggaaacagagcaaacgattcccgtgagcatcggagccgtgatttccgcgaaaagcgtgacatgacggatcggcgtggaaataaccggggacgtcattgacatataaaaacagcaccgggcaggtgaagaccgcggtgctgtttttgtttaaaaagtgagcggagagcatgggattcgaacccacgttgcgtctattcgacgcaaaccgcatttcgagtgcggcaccttcgacctctcggacaactctcccttgaaattcatctccgatgaatttcctacgtacatcgcttccgcggagcggaactttcatgcgatgtgctccttgaggtatagcgtaagctatatctcctacgtacatcgcttccgcggagcggaactttcatgcgatgtgctccttgaggtatagcgtaagctatatctcctacgtacatcgcttccgcggagcggaactctcatgcgatgtgctccttaatagtatacagaatttacatacatttttcaagtcgcttatcttgtgaatgaacaaaaattatactataatataaatgtgtatgcgaaaaaacattttgtacacaataagagaatatgcaggaggaaacgtgcatgatgaagatcggaatgcttaccagcggcggagactgccaggctttaaatgcagccatgcgtggtgttgtaaaaggacttactacaaacgtagacgaactggagatttatggatttgaaaatgggtacaaagggctgatctatgaacagtacaggattcttacagcctcagatttttctggaattcttaccagaggtggaacgattctcggatcttcccgccagccattcaaacagatgcgtgtgccggatgaaaacggactggacaaggtagaggcgatgaaatccacataccgtaagcttggattggactgtctggtgatccttggcggaaatggtacgcaaaagactgccaatctgcttcgtgaggaagggctcaatatcattcatcttccaaagaccattgacaatgatatttacggaacagatgtgacattcggttttcagagtgcaattaatatagcgacagagaccatcgattgcatccatacaacggctgcttcccacaaccgtgtatttattgtagaggtgatgggacacaaagtaggatggcttaccctgtatgcaggagtggcaggcggtgccgacattattctgctcccggagattccgtatgatattgataaggtcgtggatgcgattcataagcgtacaaaagacggaaaaggatttacgattcttgcagttgcagaaggtgcaatctccaaagacgatgcacagcttaccaagaagcagtacaaggcaaaagttgcatcccgcaggtacccatcggtttcttatgagattgcagatcagattcaggagaaatgcggtgtggaagtccgcgttgcggttccgggccacacacagcgtggcggcagtccgtgtccatacgacagagtattatgtacccgtcttggatctgccgctgcccaagcaattatggatggaaaatttggctgcatgatcgccatgatcaacaacaagaccaaatgtgtgccgcttggagaggtggcaggcaagttaaagacggttgatccggacagtcagatgattcaggaggcaaaacggatcggtatcagttttggagattaaatttcctgatatccggcaaaaaggagaagaaaaatgtcttacacggctttataccgtaagttccgtccgcaggaattcgaagatgtcaaaggacaggaacacattgttacaacattaaagaaccagatcaaagccgatcgcataggacatgcttatttgttttgcggtacccggggtaccggaaagacgacagttgcaaagatttttgcaaaagcagtaaattgtgaacacccggtagacggaagtccctgtggacaatgccctgcatgtcagggcattgccgccgggacttctatgaatgtcatagagattgatgcggcatcgaacaacggcgtggataatatccggcagatccgggaagaagtatcttaccgcccgacagagggaaaatacaaggtttacattattgatgaggtgcatatgctgtcggcaggcgcattcaacgcgctgctcaagacgctggaggaaccgccggcatatgtgatttttattcttgcgacaacggaagcacacaagatcccgattacgattctgtcccgctgccagagatatgattttcaccggatttccattgataccattaccgatcgtctggcggaactgatgcgtaccgaacaggtggatgtcgaggagcgcgcactgcgttatgtggcaaaagccggggacggttcgatgcgtgatgcgctgagtctgctcgaccagtgtattgcttttcatctgggggaaaaactcacctatgaaaatgtgctggaagtgctcggtgcagtggatacggaagtgttttccgcactgttgcgccaggtgctggcaaaagatgtgaccggtgccatccggacggtggatcatttggtggatcagggacgggaactgggacagatggtgaacgattttacctggtacatgagaaatcttttgctcatccagagtgcggatgacatggaggaagtgctggatatgtcggcagatcatctggcagccctgaaagaagaggcacagatggtggagccggaaacactgatccggtatatccggattttctcggaactgtccagccagatccggtatgcggcacagaagcgcatcctgctggagattgcaattatcaagctttgccgtccgcagatggaaaaagatctgtcggcactcaatgagcgtatggatgatatggagcagaaattagaaagcggggcatttgtttcggcggcaccacagagtgcagcagttccggcagcaggtggcacgcaggctccggcggcacaggcaccggagaaaacacagtttcccaaagccattccggaggacattaaacaggtgatgaacaactggcgatcggtcatttcggagatgggaggcatcaccagacagtatttgaatcaggcggtgccgacgcttggaccggcgggagaactgctcctggtgtttgacgatgccaacgcttttgcctatctaagcgacaataaggcagggtgtattgatcatttgaaagaaatgattgcgcagcggtgtgcaaagcaggtagaagtgcagctccgcttaaatgaaggaggacgcagcgcagccaatacggtaccggatttgcggcaattaatcaattttgatattgaggaagagaacttctaatggtatgataatacaagattcgtaaataactgaaattagaaagcaggaggaccccacatggcaaaaagaggtggattccctggcggtatgccgggaaatatggcgaatattatgaaacaggcgcagaagatgcaaaagcagatggaagaggcgcagaagaatttagaggaacaggaagttacggcagcagcaggaggcggagccgtggaagtgacggtttccggcaagcatgaggtgacaaaggtaaaactggcagaagaagtagtggatccggatgatattgagatgctcgaggatctgatcatggcagcgacaaatgaggcgatgcgtaaaattgacgaagcttcccagcagtccatgtcacagattacaggggcattaggtggaggacttccgttctgatatggattattacagtcatgagattgcaaaattgattgaagaactgtctgcacttccgggaatcggagccaaatccgcacagcggctggcatttcatattctgaatatgccacaggatcatgtggatgcactggcatcggcaattgtttctgcaaagaaaaatgtcaaatactgcaagtgctgttataacctgacagatcaggaaatttgtccgatctgcagtgacacatccagagatcacaagacgattatggtggtagaaaatacccgcgatctggttgcctatgaaaaaaccggaaaatacagcggggtctaccatgtgttgcatggtgcaatttcccccatgcttggaatcggtccgaacgatatccggctgaaggaactgatggtgcgtctggaaaaagatgtggatgaggtgattattgcaacgaattccagtctggaaggtgagacaacggcgatgtatatcagcaaactcatcaaaccgacagggattaaagtgacacggattgccagcggagtgccggttggcggagatctggaatatatcgatgaagtaactcttctgcgtgcattgcaggggagaacagaattataaatatatagctattcttgtgtttaaaggaggaaaggacaaataatgaatcatttagaattggaaaagcttgcgaatgaaatccgtaagagcattgtaacggcagtgcacagcgcaaaatccggtcatccgggcggatcgctgtcttcggcagatatttttacatatctgtatttcgaagagatgaatattgatccaaagaacccgaagatggaggatcgtgaccggtttgtattatccaaaggacatgtggcaccggcttattattccacacttgcggagcgtggatttttcccgaaggaagatcttgtgacactgcgccatacaggttcgtatctgcagggacatccggatatgaagcatattccaggtgttgatatgtccagtggatctttgggacagggcgtttccgcagcggttggtatggctgcagccggaaaatttgataacaaggattaccgtgtatacacattaaccggagacggtgagattcaggagggacagatctgggaggctgctatgtgggcaggacaccgtaagctggataatctcgtggtgatcgtagacaataataatctgcagattgatggggagattgacaaagtatgttctccgtatccgattgataagaagtttgaggcatttaatttccacacgatcgtgattgacggaaatgatttcgaccagatccgtgcagcatttgaggaagcgaagaagaccaaaggtcagccgactgccattattgcaaagaccatcaaaggaaagggagtttcctttatggagaatgaagccggatggcatggaaaagctccgaatgacgagcagtacgaaatcgctatgaaagatcttgagaaagcaggtgaagcattatgtcagaagtaaagaaaattgcaaccagagacagctatggaaacgcattggtagaacttggaaaagagcatgagaatctcatcgtgctcgacgcagatctggcaggtgctaccaaaacctgtattttccagaaagaatttccggagcgccattgggactgcggtatcgcagagtgcaacatgacaggtattgctgcaggattatctacctgtgggaaagttccgtttatcagttcttttgcaatgtttgcagccggacgtaactacgagcaggttcgcaactccattggctatccacatctgaatgtaaagatcggagctacccatgcaggaatttcggtcggagaagacggagctacccatcagtgtctggaggatctggctctgatgcgtgagattcctggtatggtagtgatcaacccgtcggatgatgtggaagcacgcgcagcagtacatgctgcatatgatcatgtgggaccggtgtatcttcggtttggacgtctggcagtgccggtgatcaatgacagaccggattacaagtttgagatcggaaaaggaatcgtattaaaagaaggtacggatgtaaccatttttgcgacaggactggaagtgtcagagtccttagaagctgcaaagatgctggagaaagatggaatttctgcagaagtaatcaatatccataccatcaagccgattgacgaggaactggttgttgcatctgcaacaaagacgaagaaagtcgtaaccgttgaggaacattccgtaatcggtggacttggaagcgcggtagcggaagtattgtgtgaaaaggcaccgacaaagatgatgcgtatcggcgtgaatgaccggtttggagaatccggaccggcggttgagctgattcataaatacgaactggacgcagaaggaatttacaaaaaagtaaaagcttttgcaaaataatacagcaagtacaaaggaggctgtcgtatcgaaggatatggcagtctttttttgcctgaagtctggaaatatgtccggtagtgtcgtacgatttttttcatgcctgtcaggtttttccaaaattctaccggatggtggtgatactatattctggaaaaacggataaggaggcaggatatgatagatattgcagaaggaccgggacgtgacctgaaaaatatcagacagatcggaacaccggcagagggggatcggatttacatagaaaatgcggcgtatgccagggtgcatgaagaaacttatgaggagcggagagtgtttatctttatggggcatacagagtgcgagcagggtgtatatatgacctttgtagaggctgccattccggtaagggatatggagttttcacagaatctgccgagatggggaacacatgcgtggtcggatgtattccgtgagattaagagatcttatgagaattccattattgtcggatgggcgttggattgtaaaggatatccaccacgcctgacagcagaactggaagctatccacagagaacagttcggaggtgcacatcaggttcttttccttatggacagtatggagggggaagaatacttttatctgcataaaggcaaccggctgcaaccgaaaaacgggttttatatctattatgcaagggaactgcatgagatacggatcccggatgtgacgattgaactgccgagacgtggaacccggcagatgcttccggagattctgacggagagcaaaaaagagaatgaaaaagaagaatgcagcagttcaaagagcgaacgcaaaccaacgtcgtatgcgatggctgccgcaatcgcactgcttttggttctgaccggggtcggaatctggcagcagcgaattcctattccgggtctggaacagacggtggagacgataggggaaaaaatccgccatgtgtcacaaccggcagaagtcctggtgggaactgaaaaaaatatagtggaagaacagacggagagcgcaaagagtacggaaaccatcagtgaacccatgcagctgataccgattgaagaggttccggcgggagcggtgaaaaaggcagaggaagcggctccttccacacagccggccgaggagaaagaaaaacctgtggcggtagaaaatacacaaaattattatgtggtacagcagggggatacgctgagtgggatctgtaaacaggcatacggatcaatgaaaaaattaaaagagcttgaaaaggcgaatgatctggaagattcggatgatatcagggttggacagaaattattacttccgtaacggggattgcaatgctataatgatagaaacgtaagcgaaaaggagaaaaatcggtggctgaaaaaacggaatttaaaaccgtagagacaagtcaggaagacctggaggaactggaagaaaaaatcaggagacacaggcataaaatagcccgcagaacggcacttgtgatcgttactgttgtagcagcagtgatttttgtagaactttggtctgcacttcgcacatattcaggatttgaggtgcaggcatcggcggagagaaaggacagtgcggcaacgggatataagatgttccagggaaaaatactggaatatgataatgacggaatcgtgtgtcacgatacagatgaccggctgatctggaaccagtcttatgaaatgactgcgccggaactttccgtgtgtgaacagtatcttgcagtttatgatcgtggagggacatttatttatatcatgtcggaacgcggactggtaaagaaaatcgaaacggcaacaccgattgaacgtgtatgtgttgcccgtcagggaacggtggctgtgctgatgaaggaggatgatgtctcgtatgtacggctttatgacaaaaagggacaggaacttgccagtggtgaattttatcaggaaaaaggaagttttcctgtagatattgcgctggctccggatgcgcagaaactggcagtagatatgctcgacgtgacaaagggcaaaacctgttccacggttactttctataactttggttcggttgggcagaatgaaatcgacaacaatgtgggaacgtacagttacaaaaatacgatgatatcggaactggtttataccgaatccggaaaacttctcgcgatcagcgatgccggactgatctggtttgacggagcacaaaaacctgcgccgaaaaaacagataaagtttaaacgggagatacagagtgtcttctataataataaatatgtcggtatttcatacagcgataccaaaaaagaaaacagctggcacataaaagtctatgacatgaatggtaaaacggtcatggagaatgatacagagatcgcatacaacagaatcgagctcctcgataataatgaaatatgtgtccgggatgattataactgtgaattgtttaccatacacagcatccgtaaattccgttatacgtttgaccggcagctttataacgtattgtcgggatcggatggtcagaattatacattggtattaaacggagaaatagaagaggtacgattacaatgaactggttattgatactggttgtattacttgttgccggaaatattgtctggggattcttccgtggtttcctgcgtgtggtttattcaatggctgcctggatactgattctggtttttgttacgtttgcaacgccgtatgttgcagactggatgacagaacacacaggcctggataccagaattgaaaagaattgcaaagagaaattgcaaaatgccgtggcaggggaagaaaaaagtacagaagaacaaaacacgcaggaacagaaagatctcagcgggctgggaatgaaactgccggcaaacgtatggaaccagataggggatacacataaacttgcggatggctggatggagcaaagcggactgtataatacaattgcgtcaaaagcatcatcccttgccatgaaagcgattgcatttgttattgttatgctgattacggtgatcgcctttcatctgattgccactgcgattgatctggtggcaaaactgcccgtaataggagaagtaaatcatatgcttgggggaattgccggattgatcaaagggctgttgctggtatggctggtatttgcgtttgcagcaatgggggcagcgacagaagccgggagtgttgtgattgaagcggtatatcagtcggaaattctgcaatggctatatgaaaataatttaatactgacgattctgctttcgtttttatgattgaattgtggtttgtaagcacccagggaacaatatcttgtggtgcttatatttttgcaaataaaatgtaaagtttttgttgactttaggttatctgcgtgatattatatctaagctgactcgtgacgaggacactgatacaggcactggcaggaagctgagtgatggttggtggtcatgatgatgaaaaaagttgttgacaaacaatgacaaacatgataagatatcagagttgtcgcgtttgagagataacaaagaaaataaaaaagttgttgacaacgacttgaagatatgataaaatatacaagctgttggaaataacaacaacgaacattgataactgaacagtgaaaaaccttgaaagattttgagaataattcaagaacgcttctataaagaagcaaccttaaaacagtaaatcaggacattgtttctgattaaaagccagatttaattctggcaggacaaaacttttaacatgagagtttgatcctggctcaggatgaacgctggcggcgtgcttaacacatgcaagtcgaacgaagcactctatttgatttccttcgggattgaagattttgtgactgagtggcggacgggtgagtaacgcgtgggtaacctgcctcatacagggggataacagttggaaacgactgctaataccgcataagcgcacaggatcgcatgatccggtgcgaaaaactccggtggtatgagatggacctgcgtctgattagccagttggcagggtaacggcctaccaaagcgacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaagaatgacggtacctgactaagaagcaccggctaaatacgtgccagcagccgcggtaatacgtatggtgcaagcgttatccggatttactgggtgtaaagggagcgcaggcggtgcggcaagtctgatgtgaaagcccggggctcaaccccggtactgcattggaaactgtcgtactagagtgtcggaggggtaagtggaattcctagtgtagcggtgaaatgcgtagatattaggaggaacaccagtggcgaaggcggcttactggacgataactgacgctgaggctcgaaagcgtggggagcaaacaggattagataccctggtagtccacgccgtaaacgatgaatactaggtgtcggggagcattgctcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatctcgatgacagagtatgtaatgtactttctcttcggagcatcggtgacaggtggtgcatggttgtcgtcagctcgtgtcgtgagatgttgggttaagtcccgcaacgagcgcaacccctgttcttagtagccagcggttcggccgggcactctagggagactgccagggataacctggaggaaggcggggatgacgtcaaatcatcatgccccttatgacttgggctacacacgtgctacaatggcgtaaacaaagggaagcggagccgtgaggccgagcaaatctcaaaaataacgtctcagttcggactgtagtctgcaacccgactacacgaagctggaatcgctagtaatcgcagatcagaatgctgcggtgaatacgttcccgggtcttgtacacaccgcccgtcacaccatgggagttggaaatgcccgaagtcagtgacccaaccgcaaggagggagctgccgaaggcaggttcgataactggggtgaagtcgtaacaaggtagccgtatcggaaggtgcggctggatcacctcctttctaaggaaatcaagtagagatttttcactgttgagttatcaacggcggtgtttgcgaagcaaatattgtcaggataacaattaaataaaaccctttctagtgtcgatgcgcttaggggaaacacccgtccacatcccgaacacgatggttaagacttaagcggccgataatactatactggtaacggtatgggaaggtaggtggatgctagatttatgggcttatagctcagccggttagagcgcacgcctgataagcgtgaggtcggtggttcgagtccacttaagcccattagaatgggggcgtagctcagttgggagagcacctgccttgcaagcagggggtcaagagttcgaatctctccgtctccattatcagcggatgaaaataatatctgctgagaaatgtactttgaaaacttcatacagaatgataagatgattaaatatctatttgatcaagacatcgtaataaccgtaaagttctttaatgaataataagtaactgaccagaagttggttacgaaagttatcaacgctatgataacgaggattgaataatcaagcaaaaaagagcgcagggtggatgccttggcactaagagccgaagaaagacgtgataagctgcgaaaagctgcggggagatgcaaataatctttgatccgcagatgtctgaatggggaaacccggctggaaggactccagtcatccatacgccaatccataacgtatggaagggaacccggtgaactgaaacatctaagtagccggaggaagagaaagaaacatcgatttccagagtagcggcgagcgaaatggaaagaggccaaaccgttgtgcgtgcacagcggggttcggaccgcataattgattcagtgattctagcagaaaggttttgggaaagcctgccggagagggtgaaagccccgtaagcgaaaggaaaactgacaaggcggtatccagagtacatcgagacacgtgaaaccttgatggaacacgcggggaccaccccgtaagcctaaatactacttagtgaccgatagcgcatagtactgtgaaggaaaggtgaaaaggaccccgggaggggagtgaaagagaacctgaaaccctgtgtttacaatctgtggaaggtctttatatgatcaaccgcgtactttttgtagaacggtccggcgagttacgcgtactggcaaggttaagtgcttaaggcacggagccgaagcgacagcgagtcttaactgggcgatgagtcagtacgagtagacccgaaaccgggtgatctatccatgtccaggatgaagatgccgtaaaaggcattggaggtccgaagccacatccgttgaaaagggtgggcatgaggtgtggataggggagaaattccaatcgaacccggagatagctggttctcctcgaaatagctttagggctagcctcgttttagtcttatggaggtagagcactgaatttccgcgggggcgtcaaagcttaccaaagaatatcaaactccgaatgccatgtagatgatgaacgggagtcagactgcacgagataagttgggcggtcaaaagggaaagagcccagaccaccggctaaggtcccaaagtgtgtgttaagtggaaaaggatgtgggaattcgaagacaactaggatgttggctcagaagcagccatacattcaaagagtgcgtaacagctcactagtcgagagtccctgcgccgaaaatgtccggggctgaaacacaacaccgaagccgtggactccgtaaggagtggtagaggagcattcttaaaaccgacgaagctgtaccggtaaggagcagtggagggataagaagagagaatgccggaatgagtagcgagaggaaggtgggaatccttccggccgaatatctaaggtttccagagtaaagctgatctgctctgggtaagtcggggcctaaggagaggtcgcaagacgtatccgatggacaacaggtttagattcctgtaccgcatataaacagaactgtggggacgcatgtggaaagcataagccgggaatggaaagaccggtacaagcgaggtaggtgtgtgacaggcaaatccgtcacataagccgaagacgtgatgtggagcgaaatttagtagtgaagtatgtgagccatgtgccgagaaaagccgctattgttttatatgtgcccgtaccgtaaaccgacacaggtggatgaggagagaatcctaaggccgacggaagaagcattgttaaggaattcggcaaaatgaccccgtaacttcgggagaaggggtgcccactgaatggtgggccgcagagaataggctcaagcaactgtttagcaaaaacacaggtctatgcgaaaccgaaaggtgaagtatatgggctgacgcctgcccggtgctggaaggttaagaggagaggttagcgcaagcgaagctttgaatttaagccccagtaaacggcggccgtaactataacggtcctaaggtagcgaaattccttgtcgggtaagttccgacccgcacgaaaggcgtaatgatttgagcactgtctcgacaatgcatccggtgaaattgaagtaccagtgaagatgctggttacccgcgccaggacggaaagaccccatggagctttactccagtttgatactgggattcggtactgcacgtacaggataggtgggagactgagaactatggacgccagtctgtagggagtcgctgttgggataccacccctgtagtactgggtttctaaccatctgccgtgaaccggcagtgggacaatgtcaggcggggagtttgactggggcggtcgcctccgaaagggtatcggaggcgctcaaaggttccctcagaatggtcggaaaccatttgaagagtgcaaaggcagaagggagcttgactgcgacaccgacgggtggagcaggtacgaaagtaggacttagtgatccggtggtataaagtgggattgccatcgctcaacggataaaagctaccctggggataacaggcttatcactcccaagagttcacatcgacggagtggtttggcacctcgatgtcggctcatcgcatcctggggctgtagcaggtcccaagggttgggctgttcgcccattaaagcggtacgcgagctgggttcagaacgtcgtgagacagttcggtccctatccggcgcgggcggaggatatttgagaggagctgtccttagtacgagaggaccgggatggacggaccactggtgtatctgttgtcgaccaacggcatggcagagtagccaagtctggaagggataaacgctgaaggcatctaagcgtgaagcccccctcaagatgagatatccctccttcgggagtaagaccccttgaagactacaaggtagatagggcagaggtagaagtgtggcaacacatggagctgactgttactaataggtcgagggcttgattaaaaagcggttgaatctgtatgaagttttgaaagtatattatttatggcctagtggctcagttggttagagcgccgccctgtcacggcggaggtcacgggttcgagtcccgtctgggtcgtttcagtaattgtttttacgattacgatatgggatcttagctcagctgggagagcatctgccttacaagcagagggtcacaggttcgagccctgtaggtcccatttattcatatgccgatgtggctcaattggcagagcagctgatttgtaatcagcaggttatcggttcgagtccgatcatcggcttttatacaatttcatattgtatatatgggcagattcccgagtggccaaaggggacagactgtaaatctgctgcaaattgcttcggtggttcgaatccacctctgcccattggaattactttttcagtaattgcatataataaaatatattatcgcgggatggagcagtctggaagctcgccgggctcataacccggaggtcataggttcaaatcctattcccgcaactatgtgcctagttagctcagttggtagagcagaggactgaaaatcctcgtgtctctggttcgattccggaactaggcacttttaattgtatagagaacatattggtataattggaaacgacacatgtgtgcattactcactgattaacgaacaacacgcgtgtgtttttctatgctcaaatttatttatattaaaggagggcaaaattatgccaaagaagagtagactcgaaaatattttatttacacttgttatggcgtttgtcatggtgtatgccatggtatgctataacatcgcaatcgacaaaggcggaatgacaaacgaagtttttctgctggcgtttcatgaaataccgattatgtggccgatcgcatgtatcctggagtattttgtagtggagaaactggcaacgatgctggcgtttcgtctggtaaatccgaaagaagacaagccggtctttgtgacacttgcaatctgttctatgattgtatgtctgatgtgtccggtaatgagtctgattgccacagttttgtttgcacatccgggaaatcaggtgatcgcagtgtggctgcaaaaatttgcattaaacttcccaatggcattatgctggcagatcttttttggaggagtatttgtaagaaacttatttatatgggtgaaaaaagcgattcatcataaataaaatcatcatgaataaaaagagggtgcgcataatgcgcaccctctttttgggggtaggaaaataatgaaaaatggtaaaactgcttccggcacaaaaccggaaacaagaattactgtgattaagtattagcccataaccacttcgacagagacttctgtcttgccggttggtaatggaatcgtatttccgtctacggcaatgccatcaacggtcatggaagcaacacccttttctacgtgttttgggttacggacgctgatgtgataggtcacaccacggaagtcacgttttgcttcgaaaccatccagagtggatggaatacatggatcgacggtcaatccgtcgtaatccggacgaattccgagaatatactgggaaacgtccaggaatgtccacgctgcagtaccggtcagccagctgttcttggcttctccaaagtttggagcatcttttccggcaatcatctgcgaatatacataaggttcggtacggtgaatttcgctgatatcttcgatatatgcaggacaggttcttgtatatacctgccatgcacggtttccacgtccgacaacggtttctgcaatggaaatccaaggattgttgtggcagaagataccggcattttctttatatcctggtggataagaggaaatttcaccaagttcaacatggtatctgtgataaggtggctgaagaagtacaataccgtatttagtatccagatatttttctacggattccatggctttcagacagtttccttctttcaggccgatctctgccataacgcagaagccttgtggctcgataaaaattttaccgtcttcacattctttagaaccaatcttgtttttgtaatgatcgtatgcccgcaggaaccattctccatcccagccagcatcaagaaccgtcttttccatttctgcgatagcattttctgccagttttgcttcatcctcaagccctctgtgacggcagatctctacataatctttaccgtaacggacaaacataccggcaatgaaaacagactctgcatttggtccttcggatgggccgaatgtctggaaggattctcccggttctgtggagaagcagtttaagttcaggcagtcattccagtctgcacggccgatcagcggaagtttatgcggtccgagatgatcgatggtgtagtggaaggaacggcgtaaatgctccataaaatcagttgccttagaaggatcactgtcatacggcgttttttcatccaggatggtgtaatccccggtttctttgatgtatgctgcggtacctgcaatcagccagagcggatcatcgttgaaaccgcttccaatatcagaattacctttcttggtcagaggctgatactgatgatatgcacttccgtcttcaaactgtgttgctgcaatatccagaatacgctctcttgcgcggtccggaatcagatgtacgaaaccaagcagatcctgacaggaatcacggaatcccatgcctcgtccgataccggattcgaagtaggaagcagaacggctcatattaaatgtgaccatacactgatactgatgccagatgtttaccatacgatccagtttttcctcggaagaggataccgtaaagtgagaaagcagttcatcccagtattttttcagttcagccagtgctgcttctgatttttctttggtatcaaattctttcatcagagcttccgcacgtgtgcggttaatctttccatcttcggcgcgtccgatccatttttcttcaaccggattctctatgtatgccagaataaatacgaaagttttagactcgctgggagcaagagacactttcagatgatgggagcctaccggagcccatccgctggcaatggagtttttggactgatcggacacgacaacttcaggagcagagttttctccgtatgctccaaggaaggaatcgcggtcagtatcaaatccgtctaccggggcgttaactgcatacagagcatagtgattacgacgctcacggtattcggtcttatgataaattgcagatccatgaacttctacttcaccggtagagaaattacgctggaagttggtcatgtcgtccattgcattccataaacagaattctacataagaaaagacagaaaaatctttcgtctctttactgttattggtaagagtcagctgattgatctcacagttctttccaaccggaacaaatgcggtcagctctgccagcagatcatttttactgctccggaaggtggagtagcccataccgtgatgacactcataagcgtccagatcggtcttggctggcatccatccgggattccagatggtatcgccctctttaatatagtagtagtgtccattgctgtcgaaaggaacattgttataacggtatctcgtcagacgaagaagctttgcatctttatagaagctatagccaccgcaggtattggagatcagagaaaagaaattctcagaacccagatagttgatccatgggagtggtgtcttaggagaggtaataacatattctttgttcgcatcatcgaaatatccaaatttcatgtgtgtatcctccatataaaattatttacttgtgacatagtagatgaaagtggaaagaagcatttggtggagtaatcaatccatcgtgcttgttttaaatgccacttatctatgagagcgaaaacgtttaagtgctctcttttataaatagagtatagtctctgaaatttaaaaaatcaacacaaaatggcttaaaacaggcaaatacagcaacttgaacaaaaacgaaaacaaaaaatataagaaagcaacaaatgcgtgcgcaacattaaaaaaccaaaaaattgcgtaaacgtataagaataaaacagcgtgcgcatgcacggacacaaaatacacatacaatatgcacaaaacagtcaagaataaagtgtttaaattgacgaaatgacaaaaaagtattgcatttacaggcatatgggcgtatattaaagctacgaaaacgattaagaaaatttcccgaaacattggaggaatgatatggtatctttaaaaacaattgctgaacgatgtggtgtttctactgcgaccgtaagcaaagcactgaatgatcataaagatatcagcgaagagacaaaaaaccgggtaaagcaaacggcgcagacacttggatattttccgaatgcagcggccagagcgcttaagacgaaccgttcatataatatcggggtactcttcgaggaggaagccggaagaggcctgacccatgaatatttctccggtgtgctgaacggacttaagattcaggcagaaaagttaggatatgatattacatttatcaacacctgctttgaaaaccggaagatgtcctattatgaacattgccggtaccggaattttgagggagtcgtaattgtatgtgccaattttgacgacccggatgtgaccgagctgatgaacagtgaaatacctgtagttacgattgattatgtgcatcataactgcaccgcagttacttccaacaatatacagggtatggaagatctggtaaagtacatatacagtcagggacacagaaaaattgcatatattcatggacaggaaggatcaagtgttacgcgggatcgactcgcaagtttttatcggacaattgatgaactggggcttgaaattcccgatacatatgtccgctcagctgattatcttgagacaaaaggatctgcaaaacagacaaaggaactgttgaatctggaagatccgccaacctgtatcatttatccggatgatacttctttaataggaggtagaaatgtcattattgaaatgggacttcgaattccgagagacatttcggtagccggatatgacgggacgatgatctcgcagcttttatatccaaaactcacaacaattcgccagaatacagaaatgattggaagcgaagctgcaacaaggctcatcggaaccattgagaaaccgagaacaactctcgtcgagagagtcgttatagaaggaagtttagtaccgggacagtccgtaggtgcaattcagccgaaagaataaagccggcagatttcttcaaaacaaactgaccaacaggtcaacaaatattaaggagggttttatatgaaaaagaaagtcgtaagtgcactgctgtgcgcaacaatggtagcaacaatgtttgctggctgcggaagtaaagagagtgataacaatgcatcaacaccggatacttcaaaggcagataccagttctgaagtatccgaaccggcagaagacacaggaaaggttttaaacatttactgctggaacgaggaatttaagagccgtattaccgctcactatccggattataaggaagtagacgcaacacatggtaaaatcggagatgtagatgttgtctggaatattacaccaaacgatgacaacgcatatcagaacaatctggatgcaacattgttaaatcaggcagatgctccggcagatgacaagatcgatctgttccttgtagaagctgattacgcactgaagtatgtagatacggattacacaatgccgatcaaggatctgggaattaccgatgatgatctgtctaagcagtatcagtacacaaaggatatcgttacggattctaagggagtgttaaaaggtctttcatggcagggctgtccgggtgttcttttctataacagagatgcagcaaaagaagttcttggaacagatgatccggataaggttcaggaaagtgtaaaggattgggatacatataacgatacggcaaagaaaatgaaagatgccggttacaagatgaccgcttctgcaaacgatacttaccgtgtatactccaacaatgtaacatccaagtgggtagacggaaacaagatcagcattgatgacaatattatgaaatgggtagatgattccaaggctcaggtagatgcaggagagacaggtacatgtgatctctggtcagatgactggtcaaaaggcttctatccacagggtaaagtattctgctactttggacctgcatggttagtaaacttctctatggcagctgatacagaaggatctatcggttacaacggtggatggggcgcagctcagggaccgcagggattcttctggggtggtacatggatttgtgcagctcagggaacagacaatgccaaccttgtaaaagacattatgttaaagatgacaaccgatgatgatattatgaaagatatcgtagttgatgatgatgatttcgtaaacaacagcacggttatgaacggaatggcagatggatcaattaaggtaaaagacaataaagaatacagcagcaagattcttggtggtcagaatcctcttccaatgtactgtgcaggtgttgagacacttgatttaagcaacctttcttcttacgatcagggatgtaacgaggaattccagaacgctatgaagaactacttcgaaggaaaagcaacaaaggatgaggcacttgatctcttctacaaggctgtaactgagaagtacccagagttaacttactaaaaacgattattaacaagcaccacagggaccgtgcctgccatacaggaatggaggcacggtcattttaacaaaaactatgtgtaacaaaaactatattcatcataacataccagttgggaggtaggtcttatgaaaagtaatagtggaggaaaagcggtcagatataataaatggggctacatatttctgattccatttatcgttgtatttgtaatatttcagctggtaccgttagtaaacaccatttataacagtttttttgaaaattacatgtctggtctgacacaggttggaccgagatttgttggattagataactataaggctttgttcagcagtggagatatctggacgtattttaagaacacgatggttctctggatcatgtgcttcataccacagattttcctctcccttttattgggcgcatggttttccgatgtacgtctgaaattaaaaggatccagattcttcaaaacagttatttatctgccgaacctgattatggcatctgcattttccatgttgttcttcactctcttttcagatggaggaccaatcaactctttactgatgcagatcggatttatctcagaaccttataaatttttatcccacgcaggaagtgccagaggtctgatcgccatgatgaactgcctgatgtggtttggtaatacgaccattcttctgatggccggaatgatgggaattgatacttctctgtttgaggcagccgaggtggatggagctacttccacacaggtatttttcaagataacacttccactgcttcgcccgattctggtgtatgtaattatcacatccctgattggtggtctgcagctgttcgatgtaccacagattttgacaaacggaaccggtgatccgatgagatctaccatgaccttgatcatgtatctgaataagcatctgttcagtaagaactatggtatggcaggagcactgtccgttgtactgttcattcttactacagtcttaagcctgatcgtatttaaggttaccggcaatgacaagagaaaggggtaattgatatggcaaagacaaataaaaatgacatccagaagggtgtaggacttcatgcacggcgcgtcatcgcctatgtagtattgattattatctcatttttctgtctgttctggttttacattatgtttatcaatgcaaccagatcaaacggacagttacaatccggatttaccgcgattccaagtacgaacctgttaaaaaactggaacaatctggtgcacggaacgcttccaatctggtatggaatgttcaacagtctgatcatcgccgcctgctcagcagtgctttgtacatatttttcaaccatgaccgcatatgcgatccatgcgtatgagtttaggatgaaacggtttatttatccatttattctgatgatcatgatgattccgacacaggttaccgcacttggatttatcaagctggtaacaaagatgggactgatggattcctttattccactcattgttccaacgattgcttctccggttgtattcttctacatgaagcagtacatggagagtgcacttccgttatctttgattgaggcagcacgaattgatggttccggtgagttccgtaccttcaacagtatcgtacttccgcttatgaaaccggcgattgccgtacaggcaatttttacattcgtcagcagctggaacaattacttcacaccggcactgattctgcatgatgataaaaagaaaacacttccaattctgattgcacagcttcgtgcagcagactggttgaagtttgatatgggccaggtatatgtgatgattacattctcgatcctgccggttatcgttgtatatctgattctttccaagcatatcgttcagggtattgcactgggaagtgtcaagggataatgtgaaatataacgttaaaaactgcagttgatgctgtactacaaaaaggagttgccttttgcggggcaactccttttttagtgaagaatgattgatatccggtgtcggggcgtcagatggacaaatgatagatctgcatccaggtgttgatctggataaagtaagcaatgagctgcggacccgccatcagctggccgaaccatggtttgccgagttcctttggtgcggcaaggaaagcttctgttttggaacggtccagaagcggcagtaccggagaattcggatcgttcagaatttcccgcatgcgcctgatcagcatctgttcgtaggccggatggtatgtctttggatacgggctttttttgcgccagagcagttcccgtggcagcagatcggcacaggcatcccgcaacagggatttttcgactccattccgatatttcatctgccacggcacattgaaaacatattccatgatccggtgatcggcaaatgggacacgggcttccagggaagagtacatgctggtgcgatccatgcggtcgagcagggtctgcatgaaccatttgatattcagatagccaatgtcacgacggcgggcttcctcaggggattcgccatccagatgcggaacgtgggagagtgtttcctcatagcgcgcatgagaatattctgccagatccagcgtgcgaagcacgtcatcggaaagaatggaggtacgtgcagcaggatcggcagaccacggaaaaccatcccggttcataagttccggtcggtaaaaccatggatagccgccgaaaatttcatcggcacattctccggtgagtgttactttattatgtttggcgacttcggaacaaaaatacaaaagagaggcgtccacatcggtcattccgggaaggtctttggcggtgaccgcatcggacagggcagcaaagagagcctcctggctgcactctaaataggtgtgggatgttttacaatattgcagcatccggttgacgtaaggaagatcccgttccggctgaaaggcattggacttaaaatatttctcgttttcagagaagtcaaaagaaaacgtgtttaaaatttttccttctttttgcatatggagggcggctaatgcagtgacaatcgaagaatcaatgccgccggagagaaaggtgcataccggaacatcggacaccatctgtcgttctacagtgtcacgcacgagaaaggaaacggtctgtacggttttggcataggaatctttatgttcccggcagggcagatcccagtagagaatgtcgtgctgtccgtccggacagaatatatgataatgtcccggcataacttcctttacgcctgtgaatacgccgtttccggaggtgcgtgccggaccgaccgccagaatttcctgcagactgtttttgtcaatggatggagtgacatccggatgacaaaataatgctttgggttctgatccgaaaacaaaggagcttccggtctgggtataaaacaaaggctttgtgccggcacggtcacggtagagaagcagttctctgttggtatcgtcccagattgcaaatgcgaaaattccatttaatttttcaacaaaattttttccaaaatgtatataagcgcacagaatgatttccgtgtcggatgttgtggtaaagcgatatccggctgccagcagttcgggcagcagttcccggtgattataaatttctccattgtaaacaatggaacaggttttcccgtggaaagtacgtgtcataggctggataccgcttttaagatcgcggatggaaaggcgtgcatgtgacagccccacatgtggctgtagatcaatcatcgcctgatccggaccgcggtgctttaaagtttcgtgcatttgtacaaggatcgtttcccagaagggttttttgtcatagtagtttaatgaaaaatcgcaaaagcctgaaattccacacataatttgtctccttaccgttgggctgcggctctaaaagcagccatcttggttttagtctatgcagaaatttctatacaaatgcaaaaaagaggggtatgatgagtacaaaatacaagaaaaagaggaagaattatgttgaaactggaacagggaaggccaacggatacgtcaggaagactggaaaaggagatccgtgtgtatgattttttagataaacttggcgttatatatgacagggtggatcatgaagctctgatgacgatggaagcatgtgaggaggcagaccgcgtgctggaagctaccatatgcaagaatctgtttttgtgtacggcaaataaaaaagaattttatcttctgatgattgtgggagataaacgtctcgtgacaaaggatgtgtcaaaaaagcttagtacaagccggctttcttttgccaatgaatcgtatatggaagaatacctcgatatcacaccgggatctgtcagcgtgctggggcttatgaatgatactgaaaatcatgtgcagctggtcattgatgaagatgttttaaagggagaatatgtgggatgtcatccgtgtattaatacgtccagcctgcgtgtgcgcactgcagatctgatggaaaaaatcattcctgcaatgcatcgcgaggcgaagatcattcagatttagccggcttctttttgcgctggcgcagttcccggaaaaaagcagaaagcatggaagaacaggtctcttcaagaacacctctggtaatttccacctgatggttaaattgctgcatttgcagaagattcaggacagatcctgcacatccggctttgggattcatggaaccgatgattacccgccgcatacgggattgtacaattgcaccggcacacatctggcatggctccagtgtgacgtagaggtcgcagtcctcaagccgccagtcacctgtttttttacttgctttgcggatggcagacagttctgcatgggcaagcgtatttttatcaatgttgcgccggttatatcctcttgcgatgattttaccgttttggacaatcacacatccaatcgggacttcatcgatcgcataggcttttttcgcctgttttaaggcttctttcataaatttttcatcatcagtcatagacattcttccttgaaatcgttatgataattatggggataagtaaccttttaattacagtataatactataccatagaaatcatatggaaggaagaagtatgttatttgcatatgagacagaacgtcttcttttaaaaataataaagccggatcaggcagatgcggtactggatttttatatgcgggataaagaactgtttgaaaaatttgagccggaccggatgccgaatttttatacccgccagttccagagacagatgctcctgtttgagtataacatggcagtacagggaacactgttccggttttatgtatatgagaaagagcatccggagcgtatcatagggacgatatgtgtacatcatattacacgtggattttctgaacagtgtgaggttggatataagttttccagcgcatatcatcatcgcggatacgcaacggaatcactgcgttttattatggatctggtgttccgggatttaaaacttcaccgtgccatggcatgggcacttccggataatacggcaagtatccggctgcttgaacgggtggggttcgtgtacgaaggcatctgccatgattatatgatgctcaatcaaaagtggcgggatcatgcgcagttttgcatgattaatcctgattaagcggacacatccagtatccgaaaactccggtcatgtctttggagtctgaggatactgcggctgctgcctcaaattccgggaaaccaaagagcattgccatcatacgttccggttgctcatagattccaggaattccaagaaactgtcgtttttctcctttcatttccagcgttttcaacatgagatagtgataattgaaaaaaccgtgcagaagaaaacggttgttgcacagattccagttgctttttggtagctttcggatatcctgaatttctactttctgataagaggtttgtggctgccgggctgcttctggttgagggattgttttcggctgttggatcgtttccggttgaggagtaatttcgggctgccggatgggttccggttctggcatggcttgtgactgtcggacgggtaccggttctggcatggcttgcggctgacggaatcgctctggttcggttgtagattgcgtctgtatgaccggctctgtctgtgcctgagcggcaggcggtaccgcttcttttttctgaaagattaaaaattctccccggagtgcctccggaaccggagcggaagaaaggcatccggtcagaaaccttccgttgccacaggcaatggtcagggtctgtgcctgatgcacgtcaaaaccactgtttccgatccgattattttcacaggtaaagctgcaggttcccataccctgcgtgagcaataattcggtaacaggtatagcctgcagaccattttcatatactgtcagatagaccggacattttcccttgaaacggtcaaacccccggatctgaagttccatacggcagctgttttcgcgcagatcggtgcggatgaacccggtatttcgtccgcggtttccctgttcatattcataaatataagtaataaatcgtctcaattgaagaattctcctgttttgtatttgatgtcttgtatagtttatgagccggggaaaaaaatatgtcgtttattttgaaaaaaggattgacattttggtactaaagtattattataatgtcagtaacagttcctattattgttttaaactaatggagtaatgagggagagtattatgataaaacgaagtcgtcagcgggaggcgatccggcagtgcctgacaggccgctatgatcatccgactgcggaaacggtttatatgagtatcaaagacgaatttccaaatatcagtctcggaactgtttaccggaatctttctcttttgtctgatctgggggagattcaaaaaattactgtcagtggaggcccggacagatttgacggaaacccggcaccgcattaccacttttcttgcagagagtgtggatgtgtgatggatctggacatgccttcccaggaacagttaaatcagattgcagcggagcagtttgatggaacaattgaaaaccattccattttgttttccggattatgcccggactgcaaaaagaaaaacacccattaattaaatttataataaggaggacatttaaaatggcaaagtttgtatgtaccgtatgtggttatgtttatgaaggtgaggctgcaccggcagagtgcccgatctgccatgcaccggcagagaagttcgtaaagcaggagggtgaaatgacctgggcttccgaacatgtagttggtgttgcaaaaggcgtgagtgaagacattcttgcagatcttcgcgcaaatttcgagggagagtgctctgaagttggtatgtatctggctatggcaagagttgcccaccgtgagggatatccggagatcggaatgtattatgaaaaagctgcttatgaagaggcagagcacgctgcaaaatttgcagaacttcttggtgaagtagtaacagattctacgaagaagaacctggaaatgagagtagaagctgagaatggagcgactgcaggaaagacagatcttgcaaagagagcaaaggcagcaaaccttgatgcaatccatgataccgttcatgagatggcaagagatgaggcaagacatggaaaagcatttgccggtctgttaaagagatattttggttaatctttaaaacgcataaaataagcatttcagaggatagatggttgtttaactgtctatccttttttgctgcagcaaatcatctgttttccatgcccgttcggatggaaaactattgacagcaaaagtcgcatgattatagaatatagaaaagtgttactgaaaacagtgacaaaaaagagcaaggtgggaggttgcagttgtgaagagatatataaagagatggatcagttttatactttttatgtgcgtttttgtctggtatccctcagatggagtggttatggcggcagacagcggtcagaaaaacatagacatcgttggtaccgcgtcgatgaatacatatgatgtggcactccgtgttggaaaaacaaagcagcttgtgtgtaatggaacgaccggaaagatggtgtggaaatcatccaatccgaaggtcgcaacagtagataaaaaaggtctggtaaaagcaatcaaaccgggaaaagcaatgatttcggtttccggtggaaatctgatcggttctatgacctgcaaggtcggtgtgagtaaaaaaattaccacaaaacaggccagacgtaagattatggctatgaaaaagacttacaaagagggtctgtcctggacaaacgaaaaccggcagtatttctgggaagccacgaactgtcagtgttatggatgtattgccctgtgtggagaaattagtgataaagtgtttggcaaatatgcaccggtgacaaaacacagcaatttcagcaggatcaaggcaggcgatcatatccgcatcggaaacgaacattccgttatggttctccagaagaacggaaatacgcttacggtcgtggaaggaaactataatgccaccgttcactggggaagaaaaataacaaaaaaggagttacaggaaagtggtttctatgtggaaacaagatattgacagaatgcttttctgtatttggaaggggatactccaaactgttttttaaatgccttgctcagatgaaattatacatgctgctttccggtttgacaatggattttttgacataaaatatatactataagtatataacaaagaagataaattggatagtgatttcttgattatacattaggaggaatgcatatggaaaaagaaaaattttcatatcctgtttcattgcgcaggatgcagattacagataaattctggaaaaatgagatggaactggtgcgtacggaggtgatcccttatcagtggaatgcgttgaatgataaagtagaaggcgcagcaccaagttattgtatgcataattttaaagtggcagcagaaatgaaccggcaaaagagaaaacagggagctgcgtataaagaaccttcatatacataccgtggatttgagatgttaccggaagatccagaaaatctcaaggatgagttttatggatatgtatttcaggatacggatttttccaagtgggtggaagcggtcggatattcgctgacacagcatcccgatccggatctggaaaaggttgcagatgctgcaattgatattgtctgtgcggcacagcaggaagacggatatctggacacgtattatattatcaatggaaaagatggtatttttaccaacttacgcgaccatcatgaattgtactgtatggggcatctgatcgaaggtgctgtggcatattatgaggcaacgggaaaagataaactgcttcatgcggcggaacgattcgcggattatgctacagattatttcggaccggaggaaggaaaatgcaagggatatccgggacatgaaattgcagaaatggcactcgtccgtctttatgaagttacaggagaacaaaagtatctggatttaagccgcttttttattgatgaaagaggcacaaaaccatattactttgataaagaacatccggaaaccgtaaagaaagggcatgagaatgaattgcggtatagctatcatcaggcacatctgccggtacggcagcaggatgaggcgtttggtcacgcagtccgtgccgtgtacctgtattccggtatggcagatattgcacgtattacaaaggacgaagaactgtatcaggcatgtgtacgtctgtggaataatgtgacgaaaaagaaaatgtatattacagggggcatcggtgcaacacatttgggagaagccttttcttttccgtatgatcttccgaatgatacggcatacgcagagacctgtgcatcgatcggactgatgttctgggcgcggcgtatgctggaaattgttccagatgcaaaatatgcagatattatggagcgggcattgtataatggcgtattaagcggaatggctttggacggaaaaagctttttctatgtgaatccgctggaggtgctgccggaggcgtgccacaaagatgaacggaaatttcatgtcaaaccggtacggcagaaatggttcggatgtgcatgctgcccgccaaatcttgcgcgcctgatcagttccattggatcttatgcatttacagaaaatgaggatacgctgtttgtgcatttgtatatgggaagcaatgtggaaaaaacggtgaatgggaaaacggtaaacgtgcagatggaatcagatatgccatgggaaggaaacataaagatccgtgtgcaggctgaaaatgcaaaaatgacgctggcacttcggataccgggatggtgtaaaaattataaaatttccggaatagaggatgctgaacaggaagaaaaagatggatacctgtatttgaaaaaagtgtggaacagggaagaaaccttctgtattgattttccaatggaggtacagatgtttgcagcatcggagcgtgtccgcgaggatattggcaaggcagcgattatgcgcggccctgtggtttactgccttgaagagaaagacaatggaaagaacctgcatgaactgctggtcgatacagatatgcatgcatcggtgtcggagggaaaaatctgcgataccgtagtaaaaatggtagaaacagacgggtggcggctgacagagagtggggatgcagaggagactctctatcacatgtatcaaaagccgcagaagcaaaaggtacgtttgcattatattccgtattacacatgggcaaaccgcggagaaaacgaaatgcaggtatggacacgcgtgcagaacccttaagggttctgcagctgattgcggtattgcgttggcgtgacatggtaataggtccggaatgctttgctgaaatagtggttatcggcatagcctaaacgttccgcaatatccatgatttttatatcaggctgccctaagagctctttggcacgttccatagtctatgattatttttttctgactgtatttgtgcgtgaaaatacggtacttgccatgggcgaaaatgatcagcttgactatgatcgtccatatgagcggcatggaaataaatatgtggtgacttctcccggatgttatctgaaatatgaaaatatgcaggatacaaagaatgaatccgggagaatgcttcagatccggcagaaagatcctcttaccggagtctgtgtacagaccgacatacagttttatgacggagtgccggtggcaagatttgtcaaccatgtaacgaatgagggagaggaggaacaggtactgacgtacctgtcctcctttacctgctctggaattaagagagatggaaactttttgtatattccgcataatgggtggcagaaagagctgaactggcgcagatattcgtttgaagagcttggatttccggtgacacagacgaaaagtatccggagaagttccaaaacaatagaagtttacaataccgggaactggtccacaaaagagtatctgccgatgggatttctgagccatccgcagagtggcgcggggctgatctggcagattgaaaacaatggttcctggcattatgagatcgcagaccagaatgatcattatgttttgaatgtcagcgagccaaacgagatacagtcacatttcagtaaggtgctgcgcccaggagagacatttgaaagtgtgccggcagcagtgggtgcagtgcgggcagatatatcagatgcattttctgcaataacggaataccggcgaagaatccgcagaaaaaaccgtgacaacgatacactcccggtaatttttaatgattatatgaattgtctgtgggcagatccaacgacggaaaaagaattaccgctgattgatgctgcagcaaaggccggatgtgaatattttgttattgatgccggatggtacgcaaagggaatctggtgggacagcgcgaaaattgttccagtggaggcttgcgcatggactatgccctgttgtcccggttaagtatccagtctaccagtgatcaggaagaatatgatatatccggtggaagaggcacagcatgtgcgcatcaatcaggatcatacaatcacggtggaatatgagcagccggtcatggcgcgtgtttttgaagttactatttgacttttttctttgaaaccaatatattgacagagtaagtatgattagaatcataacagactgagtgaggaagaaatgtacagagcaggaattgatcttggtggaaccaatataaaagcagggattgttgacgaacaacagcatataattgcagaagcatctgtgccgacgaatgtagagagaccgtatcaggacatcataagggatatggcagaactggtaaaaacgcttttgaagcagaaaggtatcggggaaacacagctgaagagtataggaatcggaagcccgggaacgattgatgcagtacatggagttgtgttgtattccaataatttcgggtgggaaaatgttccgctcacagagcagttaaagaagtacttttcctgtccgattgcagtttccaatgatgcaaactgtgcggctttgggtgaagtaaaagccggtgcggcgcagaatacaaaaaatgcgattctgctgactcttggaactggtgtgggcggtggaattattctcgatggaaaggtgtttgagggcgcacatgcaggcggtgccgaactcggacacacaagtctgatatgtggcggtgagccgtgcacatgcggacggaaaggctgcgtggaggcatatgtatcggcgacagcgctgatccgcgatgcaaaaagagccgcgcagcagcacccggaatccatcctgaatacaatgtgtcagggagatctttcgcacatgaatggaaaaattccgtttgatgccgcacaggatggggatacagcagcagaaaaagtagtaaatgattatatttgctatcttggagaaaccattacaaattttgtcaatattttccggccggatattgttttgttatcgggaggaatctgcaatcaggggaaaaaactgacagagcctcttgaaacatacattcaggataaatgctttggtggcagcaaggcgtttattccgaaagttgcatgtgcggttcttggaaataaggcgggaatcatcggcgctgcaaatctgacaggcggtaaggaaagataaggagaatggagttattatggaagaaatttttgaacagtttaaagataaggatgcatttgatgcctactggaaagaacattatgttccgcttacttatgaggatgtaagggaagcatacgaggattttgtaaaatctgcggataagcatatttttctgtcggattatgaggaatccggtaatgtcagccgggaggattttatggacaatctttcacaggcggcgcagttcgcgtttcaggatggattgacggaagcattttatgagaagaatccgcaggtttatgagaatgcatttgcattatttgaggcggcacagatggaaggcggggatgcgaatattgcggcagcttttcatgaagagtatcagcgtttgtaccatgattttttgttggaactgtttgatgcacaatatgcggaatagaccggggaaatataggaaataaaagaaggaggcgcataatgcggcctccttttaaaatttcataaatgtgcaggttgtattcttaaaaacagaataaaggagcacttgttatgagaattgcgctatgcgaaaaacaagtgcgtaggtcatattctggaaaagaagaatatgacataaaccgagtatcccgcttcgaatcagaaacaatagacgttacctttgcagttaactccccccaggcaccctcacgtcacatgagagctttcgcttagggctgctgtattcctaccctgacccggttcacgaattcccattgcgcaagacccagacgtcaacgccacttgcgaagggcagctccaccgccctgaccctctgcgggatatcaccccaactatagcggattgttggtacaaggtaccgctaccaccccggctactcggagatttaagtataattcatatcagaggctcttgtcaagcaaaactgcccgcatctgtaaatttaaaaaaaagctaaagtatctgccaaacgaaccgataaacaatgtatagagatgcaagaacagatgcatttcggaagcttatttcaaggaagaaaggagatgctgagcatgcgtatagatgcatataaccaggtagcacagttatacggtatacaaaagaatttaaagacacagaaggcgcagaatgcagcaggtccgagagatcaggtgtccatttcacaggccggacgtgattatcaggtcgcaaaaagtgcagtatcagaagcttcggatatcagggaagataaggtaagccagctcaaatcaatgattgatgcgggaacatattccgttgagcctggtgattttgccagcaaattacttgaaaagtataatgcctgatgcaaaaggcagacgagagaggtttttgaagtggctagtttagtagaagagcttgtaacagtactggaagaagaagaaaagatttaccagacattgatttcttatggagaaaaaaagacagacatcctgattcgggcagatgttccggaactggaaaaactgacatgcctggaacagctcgcaagtgatgatctggtgacacacagcaaccagcaggtacagctcttaaaggatattgccaatgtactcggacgtacagaagaaaagatgacagttaccagactgattgctttgctggagtcgcagccggatgtacaaaaaaaactgaccgaagcgagagaccgtctgcttgcggcagcagaccggacgaatcatctgaatgatcagaatgtggctctgattaaacaggccattgagttaaacgaattcgaccttacgttgttcaagagtttgcggcaggcccctgagaccgccaattatgacaaaactgcctgcaatacaggaagcttgctgggcagcagcggatttgacgcaatgagttaaggaggaacaaaagaatgggaaacggattcggaagcttatatattggggcatctggacttcagaatgcccagtatgcactgaatacaacggcaaacaaccttgcaaatgtgaatacaacaggatatgtccgtcagcaggttcgttttgcagataaaacttataataaattaaaggacccgaataaaaatgtgaacatgcagcagtatgggctgggtgtatccattggggatgtggttcatgcaagggatattttcttagacaaatcttatcggcaggagaatggacgcaagggattttatacttctttttatgaaatcacggattatgtgcaggatctgtttcaggaattaaacggagaacagttcaaacagagtgtcagtgatctgcatcaggcatttcaggaactggagcctaatatggataattccacacaacagaatctggtacttgaaaaagcggatcttctgctgagccgtacgaagtcattgtatgatgacatgaaatcgtaccaatccaatatcaatgaacaaattaaagatgatgttgaccgtgtaaacgagatcggaaaccgtatttatgaactgaatctgcagattcagaaagtagaagctggcggacaggaaactgcaatgaccctgcgtgatgagcgtgacaatctgctggatgagctgggcggatacggaagtgtctccattaaggaagatgcgacgggatttacgtatgtagattttgaaagcacaccgtttatcgatgacaataagtgctataacatcgggctgcaggaagacaaagaaactggattttacacaccgtactggacgcagctttctgatgtggataagcagcagtatgtccgcgtatttaaaaagaacgaagtgatttccacggaattaaataccgatgtgggaagtattaaagccaaacttcttgcccgtggggacggatacggaacgtatcaggatctggaaagcgaagaggcgtatgaccgtatttccggttgtaccatgatggagacagaagcacaggtttctgcactgcttcacaatattgtgacaaaaatcaatgatgcatactgtccgaataagacagtagatacggatgtcacctataccgatgccgatgggaatcaggtatcattaaagggaaagaaagttctggatgccgcaaactgtgcagtcggggaagacggacagctgccgccgagggaactgtttacccgtgtgggaatggatcgttataccaaggtgacaggagatgatgggaatacctactatgtatacaacgaagaggacgaaaatgatcccacgacactgtattccctgaacaatatcagcatcaataaagagttgcgcaaacagatcacactgatgccgcacaagaatcagaacggtacggattatccactgggtgaaaaactgatgagcctttggaacgacaaggaaatgacactgaatccgtacgacaaaaagccgtgtacgtttgaaggctattataacaagctgatcgggcagatcggaaatgatggaagcactttccagtcggcaagtgagacactgacgggggcactgtcttccatcgacaaccagagacagcagacgatgggcgtttcctccgatgaggaactgacacacatgatcaaattccagtctgcatataatgcgtccagccgttttatgacggtaatcagtcagatgacagaactgatcgtgacaggattgaaatagagataaggaggcgtagttatgccatcacaattttttggattgaatatcggggcaagtgcgttgtcggcatttcagacctcagtgaatacagcggcaaacaacgttgcaaatgtgcagaccaaaggatataccagacagacggcaaatctgtccgcaaccgatccgatccgtgtatataccagatatggtagtgtcggaaccggtgtggaagtgacttccgtgacacaggagcgcaatctctattatgatgaaaaatactggcagagtaattcaagccggggctttttcgaacagaaactgtattatgtggatcaggtccagacaatcttccgggatgatgagcaatcgcagaaaggattttccagtattttttcccagatgtttaaggatctggataccttaaagacacagggagaagtgaaagccgtccgcaatcagtttattcatcaggcacagagcctttgcacttattttaatgctttgtccaagagcctgacggagattcaggaggataccaacgaagagatcaaggcttctgtggataatattaattccattgcagagaaaatttcggtgctcaacaagcagattaataatattgaagtacgcggaggacatgcaaatgagttacgtgaccagcgtgccaatctgattgatgagctttcagggattgcagatgtagagacgaaagaattcgaggtgacaaactccaacggacaaaacttaggaggaaccaattaccgcgtatatatcaacggacagacacttgtagacggaaacgattaccggacattaaaatgcacctcttcaaagtatctgaacaatcagatggatgccgagggcatgtatgccattacctgggaagataccggaatggaatttaatgccaaaggtgccagtgccaacggaagcctcaaggcattgtttatgatccgtgacggaaataacaatgaaaatatgaagggaacggtctcggatgcagatctgtcttctattacgataaagattccggatacaaaagtgaatgaactgtcactggcgaataaaggccggattatggtaaataataagttttattactatgatggatggacagcaaaagtcggtgaaaagggggtaaacagtgtaacatttaagcttgctccggaatcgcagatggcagatcaggcagaagctgaccgtgtcaagggagacgggcagagcaattatctgacaaccggttcttccatggatgcaatgggaattccatattatcagaatcagatcaatgagttcctgcgtaattttacccaggcattcaatgatattgaaaaacagggtgttacattagatggcgataaaatgggagccttttttgtggggacttccccaactggaaacacgtttgatgcagattcgtgggatgcgaaagtacaggcggcaaagaaagacggatggacaacggatattgaactgtcatccgatggggacagctattatcagtttacagcgacaacccttgcagtaaacagcaaatcattaaaggattccaactactttgcaacgtcaaccaagattacacagggtgaggcgaaatacgataccgttgaggatcttttgaagctgcagaaggatgtgcggatgttccgcggagattctgcggagacgtttctcgaaacactgatttcagatgtgacggttgacgtgaacaagacaacaacaagttccaataattattcgaacctgtctaccgcgattgcaacacagcgtacctcggtatccggcgtggatgaagacgaggaagcgatgaacctgatcaaatttcagaatgcatacaatctggcatctaagatgatttccgtgatgtcggagatgtatgacaaactgatcaatgagaccggggtggtatgatgcctgcggacgaaaccgtgtgagttgacagcataaaacttaggagggagatcctatgagagttaccaataatatgatcacaagcaacacaaagagcaatatcaatgcaaataaggtgcttgtggataaatataatacccagatgacaacgcagaagaagatcaataaaccgtcggatgatccggtcattgcgattcgttccctgcgtatgcagaccagtttgtcccatattgaccagtatctgaacaataacatttcggatgccaattcctggctgaatgtgacggatacggcgctggaaaatatgaaaacaatcttgacggatgtccgctcattatgtgtcaaaggggcaacggataccttaaaagaagatgaccgcagaaccattctgaatcagctgaaatctttaagtgatcagatttatgcagagggaaatgcagatttttccggcagaacggtatttaccggatatcgtacgaccgagcagctgacatttaagacagatgaagagacaacatcctacacgattgatcagaaattatcctataaagatatttccgaggcacgctacacatacggaaacgtagatgtaccaacggatgcggcaaacagctttgatgaaaagatttccatcggggaaaatacctacgaccggctgcgcctggcgtatggaaagattaacggaaaagataattcggatggaacgggagcaattgatccgatttccagtatgagttatacgacagctgcaggaaagaaagtgaaattaaatcttgcaccgggacagactagcggacaatttgtagatgagaatggggcagcaaccggcagtacgtttaccatgtacgaatccaaagaggagtggcttaaggataaggcgaacaacggggaagccaaagtcggagacaatgccatggtatttatcaaagataccggtgaaatgattctcggaaaagatttgtccaatacattaaagagggaaaaggcagatcttagcatcacgtacaccaaaaccggatttgatgcaggagaggttcgtccggaatattactatgactgtaagatgaagactccggatatgcaggaggcggtacagtataccaaggaagatcagccgatcaatttcgaaatttccagtggaatcatgctcgcggcaaatacacaggcgagcgatgttttaagtactgacattggacgggatatgacggagatgatgacgcttgtttctgcttccacacaggcacatgacaaagtttcacgaattgaaaagatgatgtcgatggataagtattcggatgaggagagccagaagaaacttcagacctatctggatgctgccaataaagaagctacctatgcagacgataatctgtcaaaaacctaccagcagtttatctcgaattttgacggatacctgaataaagtaaatgtggcacataccaatgtgggtggattgcagcagcgcgtggagctgacaaagacccgtgtggaaaaccagaaagagacggtagaagaattgaagtctaacaatgataaccgtgacatttcggatattatcattgattactatgctgcttacaatgcatatacgtccagtctgacggctgcatcgaaagttggaagccagacattactgaactatttataaaaacgcggagcgaaggagaaagaccatgaaggctgattcacgtatttttggacaaattgaaatagaagatgataaaatcatcacgttagagaaaggtatgatcggttttccggatctcaatcattttgcactgatttatgatgaagagaaagaaaaaaaatacaattccattatgtggctgcagtcgatggatgatccagacattgcatttccggttatgatgccgcatattgtcaaggaagattacaacccgaatgtaagtgaggaaatgattgcaccactcggaaagctgacaccggaaaacacatatattcttgtgacggtaacggtcccgaaaaatatagaagatttttccgtaaacctgaaagcaccggttgtgatcaatatggataaccgcaaaggggtacagatgatagtggaggatgattatccggtaaaatacaaagtatatgatgtgcttaaggcaaagaaagaaaaggcgggtgaataagatatgctggcattgacaagaaaaaagggggaggcccttgtaatcaacaacaatatcgagatcaccgtacttgaaatccggggagaccagatcaaacttggaattacggcaccgaaagatgttccggtataccgtaaggaagtgtatctgcagattcagaaagaaaaccaggaggcaatcagcctcgatggtatcgaagcattaaaaggaattcttggataaagcggaaaaacaatcggagggtgttaagtttttactgacacgctccgataattatttatagaatgacagtaatagattggctatgcagccggcataaccggcggcggatgatggagacaggaggtaatcatcatggcaatggaggctattaaaggtgcaggaatgacgtatcagggaagcgtgtcatctgcagaaagccagcccaaaacagattctgcggtaaaagctgcagagaccgatgcacctgaaaagggcatcgtatcggagaatataaagcaggctggtgaggagaacgtaaacacttcccagggagcagatcagcggaatacaaatgcgcagatcaaaaaagccgtggatgaagtgaataaaaaggcggtcaactcggaagcaatattcggcattcatgaggcaaccaatcgtgtgaccataaaaattattgataaagataccaaaaaagtactcaaagagatcccaccggagaaaacactggatatgattgcaaaagtgtgggaacttgcaggccttatggtggatgaaaaaagataaaaaaggggagggaaaattatgccaatcagaatgacaggtatggtgtccggactggataccgattctatcgtaaaagaactcgtttctgcatacagtaccaaaaaggaaaaatacgaaaaagagcagacaaaacttggctggaagcaggagatctggaaaagtctgaataaagaagtaaacagtttttataagagtgttggtaatctgcggtttgacagcggatacaataccaaaaagacaacatcgtccgacagcacgaaggcaaccgtcagtgcgagcggaaatgcgactgtcggaacacagaaactgcatgtgctttctactgcacagtccggttatctgacgggggctgagattaagacagcagccaacgagaaagttactacgtctacaaagctttcggatctgggtgttacagcagatgaaattacctttaatgtgggaccggcaaataattctgcatccggaaccacaaaacagatcaaagtaggaaaagacagcacaatcagtgacgttgtaaaccagctgaaggatgcgggactgaatgcaaattttgatgccggaaacagacgcttttatctgagttcttcagattcaggatatgcaacggattttaatattactgcggacagcagcgatacaaattctacaacattattaaacgcactgggtctgggcaagacggcaaagaagattgacggaagcgatgcggttattgttttaaatggcgtaaaatataccagtacaacgaataatttttctatcaatggattatccatttccgtcaatggagtgacagacaaagtcgatgatcttgaaaaggtcgatgtcgatgccttagatgacagcaaggcagtttctatttccacaacgaccgatacacagggaatttatgacaagattaaagacttcctgaccagttacaacaacatcatcaacaagatgacgaaactgtataacgcagattctgcaaagaattacgagccattgacagatgatgagaagtcgcagatgtctgattcggaagtagaaaagtgggagacaaagatcaaggactccctgcttcgccgtgattccaatctgagcacgattatgaatgccatgacgacttccatgaccaaggcaatttccatcaatggaaagaattattcgctttccagttttggaatcagtacacttggttatatgaattcggcagagaatgagcagaatgcttatcatattgacggtgatgaggatgatgaaaatacatcaggaaataaagataagctgatggctgcattaagcagtgatccggataccgtgattgatttcatgaagcagttgtcgaccaatctgtatacggcaatcgacaagcagatgcagagaaattccctgcgaagcagatacagcatttacaatgataaggagatgacttcccagtatacaagctatacgaagaccattgcagagtgggagacaaaaatttcggataaagaagattattattacaagaaattctccaagatggagactgcgctttccaagttaaacagccagacaagttctctttcaggtatgttcagccgttaatcagtatcatgcagggcaatcttttgcaaaataaaatatacaggaaataatagggggaatcaggatgattcagaagaatccatatgcagcgtataacaacagtaagatccagacggcaacaccggcagaactgacgctgttactctatgagggagctattaaatttacaaacattgcgattgtagcgattgaaaagggcgatattgaaaaggcgcataacaatatccgaaaggcagagaatatcattcgggagtttcagataactctcgaccacaaatatgcagttgccaaagattttgatgcggtctatacctatctgttacagagattgttagaggccaacatgaaaaaggacaaggatatcttagaggaagtgcttggtcatctccgtaccatgcgggatacatggaaagaagttatggcaaagaccgcaaacggaaacaatatcaagacaaaggaaccggtagcgtaatgccggcaggagacagtatgccagatacatatattgcaattatgctgcagagcctgaaaaaaaaggaacaggttctggatgaaattatccgcctggatgaccggcagaaagataccctgacggatccggaatgcccgtttgatgtgtttgatgaaaccgtggaggcaaaaagtgcgtgtattgatcagctgaaccagctggacagtggttttgagaagctctatgcacaggtggcagaagaactggatcagaaccgtgaagattatgcaaaggaaattcgtgacatgcagcagtgcattcgccgggtaacggacaaaagtgtcaagattcaggcgcaggaagcccgcaacaaagaactgatgcgtgaaaagtttgccacaattcacagacaggcaaaggcggtgcggaaaaacagccgtgcgattaccggatactataacagtatgaaagaatggtagttatttcataaaatgggacaaaagtactacttgataaaaaatatcatatgacttataatgaccttgttatatgactgacggataatgtggagcaccacgtgaagtataacatagcacgccgcatgaaaaatcgctgacgcgatgcgggtgcgtaggttatacatcagatagatgtatgaaggagcacaccgcatgaaaaatcgctgacgcgatgcgggtgcgtaggttatacatcaaatagatgtataacaggagtcgtaccgtctgggcaaaagataaaaaacccaggcggttttttgcgttcatttatattttccggtttttggtaaatatattgtacgaaaataaagacatgcgtgggtattgacaaaatgatgggcgttagtgtaatctatcaatgattagagaatactaaccaataagagaaggaggatcaccatgttagaaatgaaagagtgggatggattcgaaggacgtctttggaaagaagagattaatgtccgccagttcattcaggataactacacaccatatgatggtaacgaggatttccttgcaggacctacagaggctaccaatcaactttggggagcactgcagaaactgcagaaggaagagcgcgcaaagggcggagtcctcgatatggagaccgaggttgtaaccggtattacagcttatggtccgggatatattgatgaatctttaaaggatttagagacaattgtaggtttacagacagacaagccgttaaagcgtgcattcatgccttacggtggaatcaagatggctgttcaggcatgtgagacatatggatatcaggtaagtgaccaattaaaggagatttttaccaagtatcacaagacacacaacacagccgtattcgatgcttacacaccggagatgatgaaagtacgtcacaataagatcttaacaggtctgccggatacatacggacgcggacgtattgttggtgattaccgccgtgttgctttatacggtatcgaccacctcatcgaggagaagaagaaagataaggcaaactgtggctgtggtgagatgacagacaatgtgatccgtttaagagaagagatcgccgagcagatcaagtgtttagaggatatgaagaagcttgcagagatctacggatacgatatttccagacctgcaacaaacgcaaaggaagccgtacagtggttatactttggataccttgcagcaatcaagacacagaacggtgcagcaatgtccgttggtcgtgtttccacattcctggatatctacttcgagagagacttaaagaaaggcatcatcacagagcaggaagtacaggaattggttgaccactttaccatgaagcttcgcatggtaaaattcgcacgtattccttcttacaaccagctgttctcaggtgatccggtctgggcaacacttgacgttgcgggtacaggcgtagacggacgttccatggttacaaagtccgacttccgtttcctgcatacattagagaacatgggaccggctccggagccaaaccttaccgtattatattcttccagacttccggaagcattcaaggattatgcagcacgtatctctattgatacaagttccatccagtatgagaacgatgacgctatgaaaccggtatggggcgatgattatgccatctgctgctgtgtatctgctacacagacaggtaaggaaatgcagttcttcggtgcccgtgcaaaccttgcaaagtgtctcctgtatgcaatcaacggtggtgtggatgagaagaccggccagcaggtaggaccggattacaagccgatcacatctgagtaccttgattacgatgaagttatggagaagtacgataagatgatggactggttagtagatatttatgtaaataccttaaacctgatccagtatatgcatgacaaatattactatgaagcagcagaactttctctgatggatacagatttaaagagaacatttgcaactggtattgcaggtttctcacacgtaatcgattccctttccgcaatcaagtacgcaaaggttaaggcaatccgtgatgagaacggaatcgcaaaagatttcgagatcgagggagacttcccaagatacggtaacgatgatgaccgtgccgatgatatcggagtatggctgttacagacattcatggataagttaaagaagcatcacacttaccgtgattctgagcctacaacttctatccttaccattacttccaacgttgtatatggtaaagctacaggagcaatgccagacggacgtaaggctggcgagccactttcaccgggagctaacccaagctacggcgcagagaagagcggacttcttgcttccctgaactctctgacaaagatcccgtatgagtgggcacttgacggaatttccaatacccagaccatcaaccctggtgcacttggaaatgaagaaggcgagcgtattgagaaccttgtaaacgttatggacggatattttgaccagggtgcgcatcacctcaatgttaacgtgtttggcaaggagaagcttatcgacgctatggagcatccggagaaagaagagtacgcaaacttcaccatccgtgtatccggttacgctgtgaagttcattgatctgaccaaagagcagcagatggacgttatcgcacgtacctgccacgatcatatgtaataggatctaaggggtcacgagagttgcgaagcaacggagtaattcgtagatcatatccgttggaatggatatgaaatcagggttaatacatgaatgaatatttgtgtattagccctgtttttatgatataatttgcacatactaatgaaatgataattcgatgcttttattggtttggttaaaaacgaggtaaaacaatgctaggaaatatacattcaattgagacattcggttccgcagacggaccgggcgtgcgttatctgatttttttgaagggctgcaatatgcgctgcaaatactgccataatcccgatacctgggcaaaaaccgagggggaaatgaaaagcgcagaagaaattttacaacaggcgctgcggtataaaagatactggggcaaaaagggcggtattaccgtaagtggtggagaagcactgttgcagattgattttgtcacagaattgtttacgcttgccaaagaaaaaggcgtcaatacctgtctggatacagcgggcaacccgtttacccgtgaggaaccattctattctaagtttgaaaaactgatggaagtgacggatctgtttatgctcgacataaaggaaattgatgaggacgagcataaacaactgacaggccagacgaataaaaatattctggatatggcaacctgtctgtcggatcacggtaaagcgatgtggattcggcacgtacttgtgccgggcattaccgatgatgatgggcagttacacaggctccgtgcatttattgatacgttaaaaaccgtggaacgtgtggaaattttgccatatcacacgctgggggtatttaaatggaaagaacttgggattccttatgcactggaagaggtggagccgccgaccaaagagcaggtggaacatgcacgggaaatcattattcccggttataaatcctgattgtatgaacaggagggacatatgcaaaaaaggcagctgtaaaatcccatcaaacaaagagaatgggacatatgcacaaaaagatagctgtgaaatcccatcaaacaaagagagtgggacatatgtgcaaaaagatagctgaaatatcccgacagaaaaagaaagagggacatagaagcaaggaaaaattgtatatgtcccaacagtatagatggtcgggacataaagataaagaaaaacagtatatgtcccaacagcaccaataagaaggatataaagataaagaaaaattgtatatgtccagacagcagaataagagaaccatagggagcaggaaaagctgcgtagatctcattttccacccctccccccaaaaaaaactcaaaaaagaatgcgtagcagaaaagaaaacataaggaaaaacaaatcatgatacaaccagaaattttatatgaagatgcacagctgatcatctgctacaaaccggcaggcattgcaacgcagaccaaaaaactggggcagaaagacatggtgagcatacttttaaatcacgtagcgcaggaaggaaccggacagccgtttatcggtgtagtccatcggctggaccagccggtggaaggcgtgatggtgtttgcaaaaacaaaacaggcggcagcaaaattgtcggcacaggtaaaagaccattcctttgggaaaaaatattatgcaaaagtccggctgccggaaggaaaaacttttgaacaggctacggggcatgaaaagacaggaacactgcaggactggatacaatttgaaccgaaagaaaataaatcctgtgtaatagaacagaagcagagggagaacgaacgggaagacatcaggcatccggcagacgggaagcggtcgcaattgcagaaaccacggcatacagcaacgtcacaaaataagatacaggaagcggtacttgattatcaggtgatcaggcaaggagaaggaactgcattgctggatattactttacataccggccgccatcatcagatccgtgtacagtttgcacatcttggaactccgatctgcggagatcacaaatatggaaaggctgaaagaggaaccccggcactgtgcagttatcatatcgattttgttcatccggtcagtggcaaagagatgacctatgaaatcagtccgagaaatttcgaaacagaatgttaatggtattcaggtgctgagtgaacagtaacccatttagccgttatcgagcggtttcacttcacgcaaatcttgacaatcggctgtgttcgtcatattatatattcgggcttttctgcgcgttttgtgggcagaaaaggaaaactcttacacgagtataacgtaaaaaatgaccgcacagtggtcgcagaaaaggagaaagacatggcgaaagagaagaaacttgttgaagccattacttccatggaggaagattttgcacaatggtataccgacgtcgtaaagaaagcagagctgattgattattccgcagtaaagggctgcatgatcatcaagcccgatgggtatgctatctgggaaaatatacagcatgaattagaccgcagattcaaagaaacaggcgtagagaatgtatatatgccgatgtttattccggagagccttctggaaaaagagaaggatcatgtggaaggatttgcaccggaagtcgcatgggtaacttacggcggactcaatcagctaccggagcgtctgtgcgtcagacctacttctgagacactgttctgcgatttttataaaaatctgatccagtcttaccgtgatctgccaaaggtgtacaaccagtggtgttctgtagtacgctgggaaaaggaaacccgtccgtttctgcgttccagagaattcctgtggcaggaggggcatacggcgcatgcaaccgcagaggaggcacaggcacgtaccatccagatgctgaatctgtatgcagatttctgtgaagagttccttgccatgccggttgtccgcggacagaagacagaaaaagaaaaatttgccggtgcggaagacacctataccatcgaggcactgatgcatgatggaaaagccctgcagtctggaaccagtcacaatttcggagatggatttgcaaaggcatttggtatccagtataccgataaacagaataaattacagtatgtacaccagacttcgtggggaatgacaacacgtctgatcggagccatcatcatggttcacggcgacaatgatggtctggttctgccacctaaggtagcaccgacacaggtaatggttatcccgatccagatgcagaaggatggcgtattggataaggcaaacgaagtgcgtgagcgtctgggaaaagtctgccgtgcaaaactggacgattccgataagagtccgggatggaaattctctgagcaggagatgcgtggaattccgcttcgtgtggaactgggaccgaaagatattgcggcaaataaatgtgtggttgtccgcagagataccagagagaaaattgaggtttccctggatgagatcgagacaaagattccggaactgttagagaccgttcagaaagatatgtttgcgcgtgcaaaggcacatcgtgatgcacatatctgggatgcacataattacgaagaatttaaggatattgcagaaaataaaccgggattcatccgtggtatgtggtgcggagatcaggcatgtgaggacaagatcaaagaagatctggcagtaacctcacgctgtatgccgtttaatgatcaggaacagatttcagatgtttgtgtatgctgtggaaaaccggcacataagctggtatattggggcaaggcatattaaaaatcagccgggattatggatttcaaatagggggttggagccatgattgaaaagtattttaatggtgttatagaacaggtatatcacagaatcggaaccgcagaaaagaacattgttatggcaagctataacaatgacttttctgtgtccgggctggagaataaaaaacgttatcaggaagacgataacgttttttttgcctgttgtgaactgcgatatgagacattgtccggggcatatgcgccttttctggacattatctgtgacatgttccgcaaatttgtaaagggagattttgaagcttttttgcgcgaatgcggaacttatgaactgcaccggtctttgtttttagggtactatgaagatggtatctgcaaaagggaagaaggggtgctgttaaatgaagtggaatatgagcagcggcgcatgacagaagccatcgttgccatgctgaaaaaactcacggaataccggccgattatgattgtaattaaccgtttccagctggcaggacgcagttccatggaacttatttaccggctgctgacagaaccgtgtacggaaatcgggattgtgcttggagtaaacgaaatgcagccgcggctggatatggccgtcaacatgtgggatgcaatcgtggaaaaacttgaagacagcagccagatttatcatattggaagttccgggaaacacagaaaccgggagaatgcggaggatgtggaagaagagaaaaattacagccacatgcttgcaaaggtagagacaatcattacgtttctggattgtgaccaggcaaaatggtacttgcagaaacttgaatataaacttaaatttgaagatatttttgtggatgatataaccttgcgggaattttatctattgtatacccgtaccgctattttgcgtgcagagctttctaaggcactggagatggttgattcagcaatgcgtctgccatccgttcggaaagatctgttttaccgcagtgaatgttcctttttaaagggaacgtgcctgatgtatcagggcaaactgcaacaggcggaaatgtatgcacagtatgcccgggaggaagcacaaaaaagtgggaatgagaaacagatattcaaggcggaactcttgtctgttatggcgcgtatgtccggctggtacaatatttttttctgtatacaggatatcccgattcatgaagggctgattgaaaagctgatgcagaacaattaccggaatcatctggcacatatttatatttatgcatatgataatcggccggagatggttgcaagggcctaccgttccgaggcatctcttttatatttcagtaaaggggtggcactggcaaaagagattggaaatgagcagctggtatatgatgcatatcagaaaaacattatgcttgcatcaacgaatggtatgaatgagattgccatgctgtattccgtgcgtacataccagttcatgaaatcaagggatgatgtttatgagggcagaattctgtccggcatcggatataatctgagtgccatgggaaaaaaccggcttgcggagcattattataaccgtgccattgaggtgttttaccatttgcgtcttccggaggatattgcggaagtgttttacaaccgtgcactgaattatattatgcaggagaactatgcgaaggcggaacatgatctgctgatggcgatgaaggtaatagaaaaactgcatcttaacagtctgcgtgtatgtaatctgtcaaaattatatggtcttttagcacttgtgagcatcatgcagaaagaccggtttaactgtgaacgttacttgcttaactgccggcagttcctgaattatattattgagaaagaaaaagaaaatgaaaacgaggaaatcatccatgactatgccaagtgtgatgaggatatgtttctatacacattttccatggcaatgcttaaccgcatggatggaaagaaggaagaggtactggtcagttttgaacaggcagagcgtttcctgcttcaggcagagggaaatgagtttttcagttatcgtttattccggaaagagagaatgaagctgtttgaggaaatggggcgcagtgagcgctgccagatggaacgcgcaacgcttttgcagcatgaggagattaattcccaggcggcacggctacttcccatgaatctcctgaaggaaattgatctgggagagcatccgcaaacgtgtgccgtgcgggaggaagaaattgaagccctgatcaaacaggaaggccttttacaggattatgcaacgtcccggagacagatggagtttatttccacatggcagaaactgattgatgtgaacggaagcaacgtagagggtatggtacagaatgcgttcaatacgtttatgaatcatttcagcctggattgtgcattgtatatctattaccatgaagatggtgcccatgtactttataacgataccaaatgtgagatgacggaagcggacattgcggcgattggaaataccatgctggaatatccacaggggtttgcggtatcaaagatcagcgacagttttctggaacatcaggatacgatcggttatttcggaatagatgatgtatgttcgtttgtggcagcaccgtttctcaaaaacggaaagctgaccagccttctgatcacatatgtccgcatgaaggataattggcatggttcgatcgaacgctacatgctcaacgaggatgacctgagaatctattccctgctttttcgggagatggagtattcgatcaatcgcatggaggcaaacgacaagatttatatgatgaaccgcaagctgcaggaagctgcggttacggacatgcttaccggtatttataaccgtgccggtatgtacgaagagattcggcagatgattgagtgttaccgtgtgtcagaaaagacacatcatgtcgggttgatgtttattgatctggacaatttcaagcattataatgatacattcggacatgacgtcggggatctgatcttaaaggaaatggcaaagattttccgcaaggcggtaaagggaagaggatttgtcgccagatatggcggggatgaatttattatgatcttaaataccgatgaccgggaaattcttgaacagattgcaaaaggaatctatgagaaaatcaattccacgcagggattccagcggcagattgaaaattatctcggccatgcgatcacgacgaccgaaaaatcgcggattacttgttccatcggaattgcaagcgcaggggatgtgagaaaagaggaagatattaatgaattaatccgtagcgcagatgagattttatataaagtcaaaacaggggaaaaaggacactacgcatttttatgaaaattcaattaccagaacacgtaaagcaaattatacacagacttcagcaggaggggtatgatgcctatgccgtgggtggatgtgtcagagatacacttttaggacgcagcccacaggactgggacattacaacttccgcgaaaccgcaggtggtgaaatcgctgttttcccatacgattgatacgggcattgcacatggaaccgttacggttatgctggatcatacggggtatgaagtgacaacttaccggatcgatggggaatatgaagatgccagacatccgaagacagtgacttttacgggaaatctggtagaggatttaaaacgccgggattttacgatcaatgccatggcatataatgataccgcaggactggtggatgcatttgacgggattggggatctcaaacggcacgtgatccgttgtgtggggataccgcatgaccggtttggagaggatgcgctgcgtatgctgcgcgccgtgcgttttgccgcacagcttggattttccattgaggagaaaaccagacaggctgtggcagatctggcagacaatttacagaaagtcagtgcggagagaatccagaccgaaatggtgaaattgctcacctctgcacatccggaggagatgcgtacggtatatgagctgggactttccagagtatttctcccggagtttgacaggatgatggaaaccccgcagattacgaaacatcattgttacagtgtgggggaacataccattcatgccatgcaggaagtccaacaggaccggattctgcgcctgaccatgctgcttcatgatgtggccaaaccggtgtgtgtaacgacagatgaaaaagggcagaatcattttaaaggacatccggcagaaggtgcggaaatggcacgggttattttgcggcggttgaagtttgacaacgaaacaataaaacgcgtatgcctgctcgtgcgctatcatgatgaccgtccggccgtgacaccgcgcaatgtgcgccgtgcgatcagcaggatcggagtggaaaatatggaggctctgtttgcggtaaagcgtgcagatacactggcgcagagcatgtatgagcggcagaaaaagctttcctatattgatgcctacgaagaaacttatcgtgagatattaaaagaacaccagtgtgtgcagaaaaaggatcttgccataaacggcagggatctgattgcacagggaatgaaaacgggcaaagaaatgggagaagtgctgcaggcactgtatgaacaggttcttgatgaaccgcaactgaataataaagagacgctgcttgcacttgctttgcaattgcaacagacaaaacaggaataaataagacaccctttccatatgatgaaaatagattcaagtcatgtgggaggggtttcattttgtattatcagccggaagcaatgttggagcaatatgacatagaaataaaacagatcacgaaaggcagaggtgtgttttgctgtgagacggatcaggggaaaaaagtacttgcaccgtttcggggatctgcagaacgcgcaaaatttgtgcgcgaaatattatgcagcatgcaggaaaagggatatccggtggaacaggtcagtctgacaaaagacgggcagtgtgtggtaacggatgaaagtggcatgcgtttctggctgaaagatctggtagagggaaatgaatgccagacaggtcgggagaaagatgtagctgccggtgcccaggcgctggcagggtttcattgctgtgtttcatcctgtgttacggaaattccggattttatgaaaaatacaaagaatgaaccggcagtgctctattaccggcattaccgggaactgatcctggtaaaaaattttgtgcagtcaagaaaaacccgaaacgagtttgagcggtcattctgggaacagtatacgcattatatcgcacaggcgaaagaagcggtcgggatgctgcaggagcgaaaagaccaggggagaaccagggggttttgtcacggggattgtaaccagcataatatgcttcgtacagcacagggggtccggctcgtaaattatgaaaatctgttttacggagaacagatggtggatctggcaaactatctgcgtaagattctggaaaaaaacagttggagtacggacatgggaaaacatattctggaagcctatgaaaagcagagaaaattgtgcaaggaagaaaaacagctgctgcatgtgctgcttctgtttccagagaaattctggaaagtatccaatcactacagtaactcgcataaagcatgggtatccggcagagatattgaaaaattaaaccggctgattgcagcggagccggcaagggaacattttctggaaaatttgttttcttttctgtgaagaatgagctatactaaggatatgagaagagacagaattaaaaaaacaattacatatttgagtctgcttttttggctgtgtctgcttgtggcatgtggacagcaggaggagacgacagatgacggagttacctattttcatcattccatcgcagaccggaatacacaggaaacacaggagaattccacggaaacggaaaagtccgaagagtttctgctgaccgcagtcgatcagattcaggaaagtctccagctgtaccggtatgcggatggaatggaataccggtattattacggaacaggcacccgtttttatgacaaatacggaaaccggacacctgtgacaagttttgaacccggtctgcttgtgaccatcggcgatgtagacagcgaaggaatcctcacggaagcccggatttcggatcaggcatgggtatacgacaatatcacccggttttcggtaaatccggatctggacatgctaaagatcggagatggaaaatatcgctatacggatgacacgattgtgttttccggagataaaagaatccagatgacggatttgtcggatggggatacgttaagcgttgtcggcagggataaaaacattcttgcggtgcgtgtgacaaccgcacagggaacgcttgcactgtccaacaccaaactgtttgaagaaagttttttgcagctgggaacaaagatttttgcggaaattacaccggatatggagattcaggtgccggaaggaacctatgaacttcgcgtagccaatgacggatggggaggcagtacggaagtgacgattacgcgtggcgagactacaaatgtggatcttgacaccttaaaaggcgaaggaccgtcttacggaaaggtgcagtttgtcatcgatgcaaaagatgcggtgctgtcaattgacggaaaagaaacggactatgagaagccggtgaaattaacctatggaagccatacaattacggtatattcttcggattatgatacctggaagcggaacttatatgtcaactcggagaaatcgacaattgttatcaatctcgcggatgaagattccagtgaaacaggaaacagccagagcagctcagaaagcagcagccagagcagctcacaggggagcagtcagagcagttcagaaagcagcagtcagagcgagtacaagaaccggcaggaagagcttgatacactcaaggatctgatttccagtatgacatcctccagttcgcttgtgtcaaaatgacggtttttcggacagaattttggttgtttttaagtgcccaaaagcccgaaaatatcgcatttttccttgacaaaaggatggaaaacaagtataaatagatttgtaagtaatttgagagaaggaactcgaattatataatataggaatccataggaggaattttaacatgaacaaagcagagttagttgcagcagtagctgagaaggcagagatttcaaagaaagacgctgaagcagcagttaaggcattcacagatgttgttgctgaggagctgaagaagggtgagaagatccagttagttggattcggtactttcgaggtttctgagagagcagcaagagttggaagaaacccacagacaaagcaggaaatcacaatcccagcttctaaggcaccgaagtttaaagcaggtaaggctttaaaggattccctgaactaattctggtggaatatgtgggagagcgtcattggacgctctcttttctgttataaggagaaataatatgagattagataaatttttaaaagtatcacgcctgatcaagcgaagaacggtcgccaatgaagcctgtgatgcaggacgtgttatggtaaacggaaaacctgccaaggcatccaccaatgtaaaagtcggagacgaaatagaaattctgtttggacagaaatccgtaaaagtgcgtgttacggatattcaggatacgaccaaaaaagaacaggcgaaagatctgtttgaatacatatcctagaagtgtggcgcatactctttaacaggagggcgcttgtatggaagaaagaggacagtcaaacagcacagggcagcataagctgatcctgcagaaccggaaaagcggaagttttaccggtgtaacggatgttgtaaattttgatgcaaatgagattatccttgacacagaactcggacggttgacgattaagggaaaagaacttcacgtaaaccggctggacctgcagaaaaaagaagtggaaattgatggaaccgtggatatgcttcaatattccggaacacctggccggggtgtctttggaaagtggttcggttaagtggaagagggcaggatttttgtacatttttttctgtttgggatgatagcatttgcggcatatgacggaatccgtgtagttcgtagaatttttccgcatgggatctttatgatttccttagaggatctggtatactggctggttatttcgctttgtttttttctgcatctctgtcaggtaaataatggaaaaatccggggctatgtactcctgggaagccttctgggagcgtggatttattacagtttctgcagtcggtttgttatgcggtatctgacggaaaagattcattatctgaaaaagaggttgaaaaagttccgggaaatgactacaataaagttaaataagcttcgtaaaagaaagaagcctgaagaatcggagaaagaacatgagaaaaactaaaaagcgtcgccgtggaagcggtactgcaggaatcatgatcattgtgcttgcatttttggttgtcatgacggttcagatctgcaggatacgttcaaaagatgcggaatatgcggcaaaagaaaaagaattacaacagcagtatgaggaagaaaccgagagatctacggagatagatgatcttgagacgtatatgaaatcctcacaatatattgaagatgtggcaaaaagcaagcttggactgacttataagaatgaaatcatcttcaaggaaaagaagtagaaaagaagaatctgtctgaacaggttcttctttttctttaatgcattgatggaagatttgagcgaaaacttttttgaaaaccacagaaaatctgacagaatatgcgtcattgtctgtgtatacttgtccctcgaaaacaattttttggaggtgtatcatgcgtacaggacaatggaaaacaatggggataggatcgctgatcggaaaaatgatctatgcagtattcgggctggcggcaagtatgttatgtatcatgggatattatccggtggtgccggcattttacacggcatgctgtctggataaaaagagaaattttctgctatacataggactggttgtgggaatgggctggtgcatgccggtggctgcgattgtaaaatatctgtttattctttttgtactgggaatcgcaatccggttttatatatgggcaaacaggcgctgcagcggatggacggcaggaatgattgcgggaattacaacgatcgcgatgaatacatcgggacttctgattctgaatatggagaaaaaggcattgatccttggcatcagcgaaggtgtgatcgtgtttgcactggcagtattgttccattatggaatcggaatgggcagtcagattttccgggagagacataagaaccgggtggaagaggaaggcgtggaaacgatggttggaatggatcctcagggacggattcatgcatttgcagaggcagttgacgagctttccgtggcattttccgcgatggacggcaggcaaaagccaaaacagcaggatcatctggatattcttgcccaggagattaccggaaagctgtgtgcggactgcgatggatgtgtcgtgtgtttagagcagcagaaaccggatttctggataaaaatccgccggatgctgcaggcagttgcacaacacagtaccaaagaagaaattttaagtcagaattttatggaagagtgtccgcgttattccgggatggtggaagaggcaatctgggctttttcccgtatggaactcaatgaggcatggtatcaccgcctgcaggagaaccgcaaggtaatcgcggatcagctggatgcgatggcagatgctttgcaggactgggatcagggaatccggtgtatggaccggacagagcgtgttctgctggcaaagattgcgtttgagacaagggaacggggactggatgtaaaacagatacatgtttatgaggacaaagaaaagcggcgcatggtgaccgctttggtggcaagtaagtggggaggcggaattcctgttaaaaattatcgaaaagcgctcgagcgtgcttccggcatggcggtccggctgaaagaggataccagatccatactgacacaggaaccggttatgattacagcgtatgaagatacctgcttttatgcattatccggggttgcttcggaaaaagaagagggatcaagtgtcagtggagataacttttctctgttttcaatggaaaacgggcattatcatgtatgtgtctctgatggtatgggaagcggaccgtctgcattccgggaaagcgatatggtggtagagctgatgcagaaatttatggaagcaggatttcctcaggagacggctatccgcatgatgaattcggcaatggttctgcagggagatcgtgagtcttactctacactggattttatggatctggatctgtacagtgggcagatgacgattaccaaaatcggtgcagcagcatcttttctgaagcataaagaccgggtggagtgcctgcgggcgtccacacttccggcgggagtcgatgcgtcctgtaccggggatgtcatccacagaaagctcacacatggggattttcttgtcatggttacggatggtgtgttagaatatctacatgtgaaaaatccggaagaaaagctcgcggaaatgataaaagagataaaaacagagaatgcaggtacttttgccgaaaagctgatggaacatgtgatgctttttacaggaggacatgcgctggatgatatgacaatagtggtaagtggaatctgggagaaataatgatcatacaggtagaaaaatttatgagaaagtggaatatggtgccggagggaggcagggtactcgttggagtgtccggcggtgcggactctgtctgtctgtgcctgattctgtatgaactttccacgaaaatgaatttttcacttgaggttatccacgtagaacatggcattcgtggagaagagagtaaaaatgacgcagtgtttgtggaacagctctgtaaacaacgggggattgtctgtcatatccggaatgttgatgttccacgttatgccaaaatacatcatctgggagaagaagaggcggcacgaattctgcgatatcaggtgtttgcggatgcagccgggcaggacagaaacgtccggatcgcactggcgcatcatatggaagacaatgcggagaccatgctgtttcagctgatccggggaagcggactggatggactgtgcgggatgcgtccacagcggacaggaacaaacggggaaatctatatccgtccctttttgcagtgcagcagggaacagatcgaacaatttttggaggagcgggggcagggatattgtatggacagtaccaatgccaacgagtcctacagcagaaaccggatgcgaaagagggtgcttccggaactgataaggatgaatccgcaggcggtacagcatatgcagacggcgatggaacagctgcagcaggtaagagattatctggaagaagagacggtttccctggagaaaaaatttatttccggggagaggaaaaatgtgaaactggatacggacgggctggcagagctttcgcaggctgtccggatgcggctgatccgcaaagctgtctggaaagctgccggggcatgcaaagatattacggcggcacatttgcaggcagtggcggaccttctggaaaaacagaccggaagatatgtaaaactgccctatgggctgaccgccacaagagtttacaatgtgatcgaaatcatgggaaaaagaaaggaaacggaaaagatctgtctgccgatagatacggaccggctgccggaaaacctgctggccggtgaatggaaattttcgtttaaaaagtttctgtatgatgggaataccgataaaattccacgaaaaatgtatacgaaatggtttgattatgataagataaaagatagtttagctatacgtaaccgccgaaaaggagactattttgtgctggatgcggcaggacatcacaagaagctggaggattatttcgtcaatgaaaagattccggcatcgcatagagatgagcagctgcttctggccggggaggatgaaatcttctggattgtcggagggcgtatggcatatggcacagggatttccgatgcaacccgatgggtgttggagatcactgccagtaatagcagccattgaaggaggataagaggatggattacagtaagaaacatgagatatcggtatatctgaccgaggaacagttaaatcagcggattgcagagatcggtgcacagatcacggaacgtttcaaaggcgagtcggtttatctggtctgtatcctgaaaggatctatctttttcacaacagaacttgcaaagcggattgcgctgccaatgacgatcgattttatatcagcatccagctatggagcacagacccattcttccggtgtcgtaaatatcaagaaggatctggaacagtcgattgaaggggagaacgtgatcgttgtggaagatattgtggattccggaaatacattaagccggctgatgcagctgtttgagagtcgtaatccaaaaactcttacgatctgtacgctgctggataaaccggatcgccgggtggtagaaaacctgcaggtggattataccggatttgtgataccggataagttcgtagtcggatttggtcttgattacgatcagagataccgtaatcttccgtatattggattcgtggaagatgcggattaaaaaaaggagagtagtacattgaatacaaagaacagaccccgatttggaggatttggtgtctatgcgatgctgatcctgcttgtgattattttgtggtatacatttaccaacaacagtacaaccagtgatttcacacagaataatctctggaaagccatccgtgaggaaaaggttgtcagtatccgggtagagcagaaccgtgaagtaccgaccggttatctgaatatcaaactgaaagatggttctacggaacggatgtatacctcagatgtgaacgagatccagaaagaattaaaagaaaaggattttacccagtttgttgtggatgatgtgccgtcagagagctggattatgacacttctgccatatcttcttatttttggtgccatcttcattctgtttatgattatgagcaacaatgcggcagcaaacaacagcggcggcaaaatgatgaattttggaaaaagccgtgcaaagctttccaccgaggaagataaccatatgacatttgagaatgtcgccggtctgaaagaagaaaaagaagaccttgaggaactggtggactttctgcgtgcaccaaagaagtatacaaaccttggtgcacgtattccgaaaggtgtgctcttagtcggacctccgggaaccggtaagacacttctggcaaaagccgttgcaggcgaggccggagtaccgttctttagtatttccggttccgatttcgtagaaatgtttgtcggtgtcggagcttcgcgtgtccgtgatctgtttgaggatgccaagaaaaatgcaccgtgtatcgtatttatcgatgagattgatgctgtggccagacgccgtggtacaggtatgggaggcggtcatgatgagcgcgaacagaccttaaaccagatgcttgttgagatggatggatttggtgttaatcagggaattatcgtgatggcagcaaccaaccgtgtggatattcttgatccggcgatcatgcgtccgggacgttttgaccgaaagattgtagtcggaagaccggatgtggcaggccgtgaagaaattcttcaggttcatgcaaagaacaagccgctgggagatgacgttgatttaaaacagatcgcacagacgactgcgggatttacaggagcagatctggagaatctgctgaatgaggctgctattcttgcagcaaaagaaagccgggcatatattcagcaggcagatatccagaaagcattcatcaaagtgggaatcggtgcggagaaacacagccgcgtgatttccgaaaaagaaaagaaaattacagcatatcatgaatccggacatgcccttctgtttcatcttctgccggatgtgggaccggtgcatacggtatccattatcccaaccggtgccggggctgcgggttataccatgccgcttccggagaaggatgagatgtttaactccaggggacgtatgctgcaggagatcgtggtagatctcggaggacgtgttgcagaggaactggtatttgatgatattaccacaggtgcctcccaggatattaagcaggccaccaagatggcgcgcgatatggtgacacggtatggaatgtccgaaaatatcggcctgatctgctacaaagatgatgacgatgaagtatttatcggacgtgatctggcacatgcacacagctacagtgagggaattgcctctgccattgatgtggaagtaaagcgtatcattgatgagtcttatgagaaggcaaaaacaatcattgccgagcatcgggatgtgcttgaccgctgtgcagcacttcttctggagaaagaaaagattacacgcgaagagtttgaagcattatttgaagcataaaaaccatggatggtcaaaatgacagaaaaagaccctgtcggaaaaagttttccggcagggccttttcattttgtgtataatacacaaaaacaatgcttgacttttgtgaagtttgtgcacacttctgcgtagatccatggtactataatcactgtaaaaaccccccaatacattatatatagtttttgctatacccccatagtaaaaataccttctcctaaaaagacagcgttcgtagctgtcttttttatttatttttttcaactcttacaatgacaattttacttcccggttcgtgtgttcataatggcgcagtgtcacaccggcggcgcgcagcatttttttggatgcgatcacacccggggtagaagcgtatttgtcactgtcgtaaacgacttcacggataccacactggataatggctttggcacattcattgcatggaaagagcgtaacatatatggttgatccttccaggcttccgccccggtagttgagaatggcattcaattcactgtgggtagagtaaaagtatttgttgtcatcgccttcgcgtacccatgggaaatcatcatcggaacatcctgttggaaatccattatatcccatggaaagaattttgtgtttgtcactgacaatacaggctccaacctgtgtgtttggatctttggaacgcataccggagagcatggcaacgcccatgaagtattcgtcccagctgatgtagtcctgtcgttttgtgctcatatgtgttagcctcctttgtggtttttgtaaaaataacgagagggcaataagtccatactgacttttgcccccctgaatatggtaatatatgattatttggttccaaagatacgatcaccggcatctcccagacccggaacaatatatttatgttcatttaaatgatcatcaagtgctccgatgtaaagatcaacatccgggtgagcatcggtaagtgcttttacaccttccggtgcagcaatgatgcacataaaacgaatgctttttacacccttgtctttcagcatctggattgccgcgatggctgatccgccggtagccaacatcggatctacgacaaatacttcgcggttggcacagtctgccggaagtttgcagtaatattcaattggctttgcagtttccggatcacggtagagaccgatatgtccgacttttgcagcaggaatcatttccagcataccgtctaccatgccaagtccggcacgcagaatcggtaccactgccagtttttttccttttaattcttttacggtcgtcttacagatcggagtttcgatctccacatcctgtaactccagatcacgggttgcctcgtaacactcaaacattgcaacttcgcctgcaagtgtacggaaatccttagagccggtctcggttcttctcattaatccgattttgtgctggatcagcgggtgatccataacgactacttttcccataaatttattctccttcttcttcgttaagttttttcacaagttttttgattgatttgcgcagggtttcatagcataatccgtaggcgggcaaagcacctccgtatggatctaatatttccagttcgtccccgacatatttggtaagaacctgtatattttccggaacagcattttcaaactgctctaaaatgcgctcccggtgaatttcttccatggtaatgacaagagcatcttctgtcagatcttcttccgtcagctgctgggaaacataattttccatattgataccgttgctgattaagacagcttcggctttttgattcattggttcctgaaattgtacaacaagtccacgggataagatctccagcggatgacgcaaggtaaaatctcccatgataccggctgccattgcctcgcgacaggttcctgtctgggcaacaaaaatcagtttgttatactccatataattactcctaatcgcaatgtattacggtatgaccggccgctttgagcagacggttcataatggcctgtccgatgcgaggggtctgaaagctttctgaataaatggcatctacatgcaattcatcacactcacgcaaaattttgtacagatgctgtgcaatggcgtcttcgttggaacggctgcccatggaaagaatgacatcggcgtgataagaaggtccggattcttccgtggcaatgacagccactttctgtccgttctcctgcttttggtgcaccagtgcattgatcttggaaacaacagcatccgatgatccgtctacgattaccatatcggcttttggggcataatgcttgtatttcatgcccggagcttttggtttgcgcgtgtcgtctgcggcaataatacccggatctatgataacttcttcgccgagcacctcagaaagcatctgcggtgtaatatagccaggacgcagtaccataggttttgtttcggtcagatcaataatggtcgattcgatgccgataccgaccggcccaccgtctaaaatcatggcaatccgaccggataaatcctctgcaacatgagaagcttctgtcggactcggacgaccggatgtgttggcacttggcgcagcgatcagacatccgcttttgcgtatcagatcaagtgcaaccgggtgattcggcatccgtacagcgacagtatccattcctccggttgttgccatcggaacggcatcgcttttccagacgatcatcgtcaggggacccggccagaaagcaccggccagtttgcgggcagcctccggaacttcacgtgcaacacgttccatatcggaaaagtccgcaatgtgcacgatcagggggttgtccgaaggacgtccttttgctgcatagattttgcgggcagcttccggatgcagggcatctccgccaagaccgtataccgtttctgtcggaaaagcgaccagttcaccctctgcgatcagacgtccggcctcttccataattgtttcgtcaatctgttcgggattgacacgttctatttttgtattcatcatattcacactttgctttccgctttatatcccgtctattatagtccataggctctgggattgtcaatcggattagctggctgctaaagaaaatgattggtgaaaatgataaaatattctaaaaactatggaattttatagacaaaacgacgaataatgaggtataatacatccatcgggacggaggaaggctatgaaaaaagacaacagatccgtgatacagacattaacactcatttttcagtttggaatcagtatgctggtgccgatttttttatgcagtatactgggagtgtggctgggaaaccggacagggattaactggttaatgattccgtttttctttatgggagctttggcagggtttacgaatatttacaagacagtaaggaaactatacaggcaggaggaaaagaaagaaaaccatgttaaaaaggattaacgaagcattaccggggctggtcgtctcaattttattatatggggtgatggtagaactgatcggggtatggtttgtaaaggacaggattgcatattccatcggggtatggtttggcatagcggttgccgtggggatggcaattaatcttgcaactgtgatctttgattctgttacgatgggggacaccgcacatgcgacgcgaagaattgtcacaaaatcaattcttcgttatgtagtagtggtgattttgttcgtgttatttgggtattttcaatggggaaacctgattgcggcttttcttgggctgcttggtttaaaaattggagcatatcttcagcctttatgggagaaagtaaaaggaaggaggtgactatatgaatgaggggattttactggcgtcggacatcgactttatgattcatggaatttttaaagtaaaagtatttggtcaggaagtctggatcaccgacagccacgcatgtattttgattgttatggcagtaatggttatttttgctgtgattgccaatcgcaagttaaagcatgccaccgaaaaaccggatacttttcagaatataatcgagctgattgtagaaaaattagacggaatggtggattccaccatgggaaagtgggcacccagattcgtcaactatatcagcacgatttttatttttatactgatgagtaacatatctggattgtttggcctgcgcccgccgacggcagattacggaaccacgcttgcacttgcactgatcacattttttatgatccgtttcaacaaggcaaaacaccagagtctgaaagaaatatggacaggtatgtgttcaccgcttccgccatggcttccactctgggcgccgatcaacattatcagtgagattgcaataccgatctcattgtcgctgcgtctgtttgcaaatgtgttgtcaggaaccgtaatcatggcactggtatacggtttgcttgggggaattgcaacggcatggccggcagcactgcacgtatattttgatctgttttccggagcaatccagacgtatgtattctgtatgctcacaatgacttatgtgtcacaggcgtgtggagaagattgaaatgcatttttagaatgcatttcctacgcaaatcgcttccgcgtaagcggaactctcatgcgatttgctccttgtatcaaaacaagtatttaaattaaggaggattttactatgaatatttcaggacaggatttaatcagagcatgttcggctatcggtgcaggacttgcagttattgcaggtatcggacctggtattggacagggtatcgcagccggacacggcgcagcagccgtgggacgtaatccgggagcaaggggacagattatgtccaccatgctgttaggtcaggcagttgcagagacgacaggtctgtatggtcttgttgtcgcactgcttttactttttgtacatccgcttggataaaggaggggcaaacgagtgttagctgcacaggaatttttatttgatttaaatccacagctgctctttgatgctgccctgctggcaattgcagtatttttcctttatatgctgatgtcatatctgctgtttaatcccgcacggaaacttttaaaagaccgtcaggatcacatttcatcggaactggatgaggccagcgccgacaaagaaaaagcagcagcgctgaaagcggagtatgaggcaaagttaaaagaaattgacaaggaagcggaaacgattctggcagatgccagacaaaaggcgttaaagaaccagaaccgcattgtcaatgaggcaaaggaagaagctgcacgcattgtaaaacatgcacaggaggaggcacttctggagaagaagcatgccatgaatgacatgaaacaggaaatgatcactgtggcatccctgatggcacagaaagttgtggcatcttccattaccgcagagattcagagcacacttgtggatgaaacattaaaagaaatgggtgaatcgacatggcaaaattagtatccaaaacatatggggatgctttgtttgcgctggcggttgaagaacatatggtggatcaattatatgaagaggcgcaggctgttgcacagattctgcgtgaaaatacagaactgacccgcctgatgaatcatcccaaaatcgaaaaagaagaaaaagtcagactgatcgaggatattttcaaaggacgtatcggtgatgaactggtgggactgcttcggatgcttgtacaaaaagggcattataaggagaccgatcaggtattcacttattttattgaccgtgtcaaagagtataaaaaaataggtactgcctatgtcacatcggcgatggaactgacaccgcaacagaaacaggcggtggaacaaaagctgctcgacacgacaaagtacgttcagtttgagatacattataccacggaccccgcactgatcggaggcatggtcatccgggtccgggaccgtgttgtggacggcagtgtccggaccagactggaacatctgacaagagacttagaacgtatacaattgaaagtaggtgagtgcgctccatgaatttaaaaccagaagaaatcagttctgtcattaaggagcagatcaaaagatatgcttcccagctggaagtggcagatgtgggaaccgtcattcaggtggcggacggcattgcacgtatccatggactggaaaatgcgatgcagggagaattgttagaatttccgggagaggtatacggtatggtactgaacctggaggaagataatgtcggtgcggtacttctcggaagtcagcacaatatcaatgagggagatacggttaaaacaaccggacgtgtggtagaagtgccggtaggaaatgcactgctcggacgtgttgtgaatgcgctcggacagccgattgacggaaagggaccgatcacaacggataaataccgtccggtagaacgtgtggcatccggtgtcatttccagaaagggagtggatacaccactgcagaccggtatcaaagccattgattccatggtgccgatcggaagaggacagcgagaactgatcatcggagatcgtcagaccggaaagaccgcgattgcaattgacacggttattaatcagaaagggcagggggtaaagtgtatttatgtggcaatcggccagaaagcttctaccgttgccaatattgtccagacactcgaagagtatggagctttcagttatacaaccgttgttgcggctacggcaagtgaacttgcgcctttgcagtatcttgctccgtattccggctgtgcaatcggcgaagagtggatggagaatggcgaagatgtacttgttatctacgatgatttgagcaaacatgccatggcataccggaccctgtcgctgctgttaaagcgtgcaccgggccgtgaggcttatccgggtgatgtcttttacctgcattcacgtctgcttgagcgtgcggcacgtctgtcggacaaactgggaggaggttccctgacggcattaccgatcattgaaacgcaggcgggagatgtatctgcatatattccgaccaatgtgatttctatcacagatgggcagatttatctggagacggagatgtttaatgccggtttccgcccggcaatcaatgcaggactttccgtttcccgtgtaggaggagccgcacagatcaaggctatgaaaaagattgcggcgcctatccgtacagaactggcacagtaccgggaactggctgcatttgcacagttcggttccgaactggatgcagacacgagcgagaaactggcacagggagaacgattaaaagaaatcttaaaacagccgcagtatcagccgatgccggttgcaaaacagatcgttatcatctatgcggcagtgaaaaagtatcttatggacattccggtagaggaaattctgcattttcaggatgcgttactcgaacttattgataccagatatccggagattaccggaaagattacagaaacccaggttatcgatgaggagacagagcagaaactgatagcagcaattcaggaaacgaaaaaggaatacctggcgtaaaggtatgataacagggggtgataacacatggcgtctatgagggatataaaaagacgaaaaggaagtatccagagcacacagcagattaccaaagccatgaaacttgtttctaccgtaaaactccagaaagccaaagggcgggcagaacagacagatccctattttcagtatatgtaccggacggtaagttccattttagcacacagcggcaatattgatcatccatacttaagaagcggggaatccaaaaagaaagcgatcgttgtactgacttcgaatcgtggacttgcaggaggatataatgcgaatgtggtgaaactgatcacagaaagtgatgatgttgccaaagaggatgtcgtgatctatgcagttggcagaaaaggaattgagatactggagcgaaaaggatatcacatcgaggtagatgcctcggaaattatggaaaatccgacatatccggatgcagcagcactctgtaagagagtgctcgacgatttcgcggaaggaaaaataggagagatctatctggcatatacgcattttaaaaataccgttagtcaggaagcgcagctgatccgtatgcttccggtggaagtaagtgaaccttcggaggaaaagtcttccagagaaattcttatgaattatgagccaaacgaacaggaggctctgaatcagattattccaaaatatgtgacaagtctgttttatggggcactggtagaagccgtggcaagtgaaaacggtgcccgcatgcaggccatggattccgcaacaagcaatgcggaagagatgatagaggatctttccttaaaatataaccgtgcaagacagggatctatcacacaggaattgacggaaattattgcgggagcaaatgcgatagagtgacgtaataaaggagaagaaacatggaaaataaaggagcaataggaaagatcacgcaggtgatcagtgccgtgctcgatatcaaatttccggaaggacatcttccggagatcaatgatgcaatccgtattcctttaaaaaagggcggagaactgatcgttgaagtagcacagcatctgggggatgataccgtgcgttgtattgcactcggaccgacggacggacttgtccgcggtatggatgctatagcgacgggaggaccgatttcggtaccggtaggagaaaaaacacttggccgtttgtttaatgtgctgggagagccaatcgatgaaattgcacctccgcagaccaaggagcactggccgattcatcggaaggcaccttcgtttgaggaacaggcaacttcccaggaaatgttagagacaggaattaaagttgtcgatctgctctgcccatatcagaaaggtggaaaaatcggattgtttggaggagccggtgtaggaaaaactgtgctgatccaggaactgatccacaacattgccacagagcatggtggatattcggtatttaccggagtcggagagcgtacccgtgagggaaacgatctgtattatgaaatgaaagagtcgggagttatcgataagacaaccatggtgttcggacagatgaacgaaccgcctggggcacgtatgcgtgtagcgcttaccggacttacgatggcagaatatttccgtgataaaggcggaaaagatgttctgttatttattgataatattttccgttttacacaggcaggatcggaagtgtctgccctgctcggacgtatgccgtccgcagtaggttatcagccgaccttacagacagagatgggggcactacaggagcggattacatccacaaagaacggatctatcacttccgtacaggcggtatatgtgccggccgacgatctgacagacccggcaccggccacaacgtttgcacatctggatgccacaacggtactggatcgttccatcgtggaacttggaatatatccggctgtggatccgctggcttctacttcgcgtatccttgacccgagaattgtcggggaagaacattttaaggttgcgcgtggagtacaggagattttgcagaaatataaagaattgcaggatattatcgcaattctcggtatggatgaattgtcggaggatgataagcttgttgtcagccgggcgcgtaaagtacaaagattcctgtcgcagccgttttctgtggcagtacagtttaccggactggaaggcaaatatgttccggtggaagagaccatccgcggattccgtgagattctggatggaaaactggatgacgtgccggaaagttatttcctgaatgccggaacaattgatgaggtaaaggcggcatatgcagggtaatgtgtgtgccggctggaggaaacagagatggaaaagacatttgatgtagaaatcatcacgccggaccgcgttttttataagggaactgcggatctgctggagtttaatacggaatccggcgagatcggtgtatatcgtgatcacattccacttacaacggtactggaaccggggcttgtcacgatccatcatggggatgaagaacaggtggcagcagtgcatgccggatttgccgagattctgggagataaggtaacacttctggcagaactggcagaatggccggaagagattgatctggagcgtgcggaagccgcaagagagcgagcagaggagcggattcacaacagaaatgacaatctggatttaaagcgcgcggaatttgcattgcataaggctctgatccgtattaatcttgcagagtatcgataagtgaaaatggaaataaaagggagggtatttggaatatcctccctcttttatggacttttacaccggagtttggtacaatcttagtagtaagtttgtatacaaatgaggagatattgtgtaccggaagaataaaaacaattgggtaaagcatctggattttatgattctggatctgatttgcctgcaggtggcattttttttagcctatacattacgacatagaactgtcaatctatataccaattacatatatgcaaatttgtctatcgttctgatcctgatagatgtttgtcttttgattttcctgaatacacttaaaaatgtattaaaacgtggatatctggtagagtttatcgcaaccattaagcatgtggcgattgtggaactggttgctgtcctgtatctgttttcggtaaaagatgcgggaaatttttcgcgaatcacgttctttctcatggcattattctatggattgcttacttatggaacaagacttctgtggaaaaaacatattcttcgcacgctgcatctgaagcagaacaagtccgtactggttatcacaaactttgaccggctgtctcaggtggaaaaggatatccgggcgaaacgctatgtgatgtttcagatatcgggtgtggctgtgatcggaaacatgccagaggatcatccgacggaaattgcgggaattccgctggttgcagcaggtgattatgtggtggaatatctctgcagggaatgggtggatgaagtatttgtaaatctgccattgcagagtgcccagctggatgatctcatccggcagttaaacgagatgggaattacggtgcatattcagctggcagataaactgatggtcggaacacagcggcagtttgtggagcgtcttgggggatacaccgtgttaaccacaagcatcaatacgatttccaccggagaactgtttgtaaaacgtctgtttgatattatcgggggactggtgggatgtgtgctcactggtattctgtttctgattctggctcctgccattaagattcagtcacccggaccggtattcttttcccagatccgtgtgggaaaaaacggaaagaagtttaagctgtacaagttccggagtatgtatactgacgcggaagaacgcaaggcacagcttgtagcagaaaacagagtcacagacgggctgatgtttaagctggattttgacccgcgcatcatcggctgcagacagctgccggatggaacggtgaagaaaggaatcgggaactttatccgtgactggtctttcgatgagtttccacagttctggaatgtcttaaagggggacatgtctctggtaggaacgagaccgcctacagaggatgagtgggtcagatacgaactgcaccacagaagccgtctggccatcaaaccgggaatcaccggaatgtggcaggtgagcggccgcagtaatattacggattttgaaaaagttgtggaactggaccggtattacattttaaactggagtctgggactggatgtgaaaatacttttccggacggtaccggaagtcgtgaagaagaacgggtctatgtaggcgacttcccggttgcagcaataaatagtttgagaaggcgtatcgcataattcctttgggaggcgggcgccttttcgattatatggatcagtgtcattgcatctttttgctgccattcccgctccgtttcagagatttctccaaacatcatataatctaaattcatatctaacgatttggcaatcgccagcatggtttccacagacataccacacatccctcgttcaatatcggaacagtattttgttgcccggttgatccgcaccgccagttcatcctgcgagagtccaagttgtatccgcttatggcgaatccgttcgccaactgcaattctatcataaggttcccgtttcttattcatttcgtaatcctctgtattcccaaaaattaccaattttcctatataaagatagtatcagttattaaaatataataaacacttttcaaacgtaaaatataggcgcgtttaggacttgagtatttgtgcgtttacaaacggaaaaacgggaaaattcgccaattttcgcgggtaaacctactgtgagaagaccaggatatggagtaaaatatttttgtcgcaaatataattatagaataattatgaacagcaaagagaaaaaatgccgattgattttcacacacatattcttccgggaatagatgacggaagccggaatgtagaaatgtcactaagaatgttagcagcgcagagggagcagcaggttgatgaaatcgtagcaactccccatttttatgcacagaaggattctgtggaggaatttttgctgcgcagacagcgaagctatgaaaaattaaaaactgcgatggaagaaaatggttttgaccagaagctgtatctggcagcggaagtttactattttcaaggaatcggaagtgccggaatgatcccgaagctttgtgtggaaggaacacagacacttcttctggaaatgccgtttgcccagtgggattctgccatttatgcagatgtggagaaactggtacggcaccagaaactgaaagttgtccttgcccatattgagcgttattacgaattccagaagaaaaaagaaatctgggatgccgtcatggaacttccgttatacaggcagatgaatgcaggcgtatttctgaactggaaaaagaggcataaagcgtttcagcttgcaaaagaagccacaaccattattcttggcagtgattgtcacaacatggatacccggcatccaaatcttgccgagggacgcattgtgcttgtaaagaaatttggagaagcgttcctccagaaaacggatcgcctgaccagggaggtactgcagtgagcgaaaaaaagaaaaccatgcgtgcagttatagaaattatcattgccgtacttgtaatcattgccgtatattttatcatccgtgggatggatcggcacgacgtgcgtatccggcaggcagccacagaaaatgaaatgcagcgtgtctggaaagaatttcaggaaaaacccgtctcgattaagctacataaaaagacctggaaatttgcccatccggttcagacgtatctctttatcggaacggacaaaagcggaaacgaagatgccgagggagaagaatatcatggctcgatggcagatgcactgatgcttgttgtcgtggatgaagaagaaaaagcatatgggattttacagctgaaccgggacaccatcacggaagtgccaatgcttttgcaagacggaagcgctaatgccagtgcacagatgcagctttgtacggcacactggtatggaaaggacaaggctgcaagctgtgacaatacggttgagaccgtatccaaaatgcttggggggctgcctattgatggatactatgcattgaaaatggatgcaatgccacttctgaatcatgaggtggggggagtaaccgttacactggaagatgatatgaccaagctggatccggctatgaagaaaggtgcaacgcttaccttgacagaccggcaggcagaactgcttatgcagtcccggtatgtcatggatgacgatcgcaatacgcagcgtatgcgccgccagcagatctttttaaacgcattcatgaaaaaaataaaaaaacagaatgcgggggatgtcaatgcgaccgtgaaattatatgaccggctgcgcccgtatgcaacgacagatattaagatgaatgatctaactgccctgttaaagaatatgcagggatatacagacaaaggaattatcacaatcgacggtacatccaaaattggagaaaagctgcacgatgggaaaaagcactgggagttttatatggatgaagattcactggagacatccatgaaacaactgtatccactggtgcaagagaaaggaaagtaacgaatgaaccaggaaaaccaattgacagagcagaacagcgaagaaaccgaaattgatctgcttgaaattttttatctgctacgggcaaagctggtatggctgattctcgcatttgtgatcgggggagtgattgcaggctccatcacacattttctgatcacaccaaaatatacggcaactgcaaaaatgtatatgatttccgcatccagtggaagtgtgcttgatctgtcggatttcaatatcggaacatccctttcccaggactataccgaattgatcaaaatccgtcccgtgttcaatgaagtgattgataacctgaatctggatatggaatatgaagatcttttgaagaaagtaagcatctcggttgttggagattcacggttacttgctgtgtcggtggaggacaatgatccaaaacttgcacagtcgatggtcaatgaacttgtagatacagcggtaacctacattccgaaagttatgaatgcatcggagaatgcacagccgaccattgcggaatatgcagtggttccagatgaaccgagttcgccgaaccttgccaaaaatattattctcggagcggttgttgcaatgcttcttgtagccgtgatcttcgtggtacgtatgcttatggacgacagcttaaatacggcagaggatgtcgaaaaagaatttggtatcatgccgtttaccgttattccggagggggatatcgaagaaatttctgatgaggtagaaaaagcgatcagtaaagagaaaaagaaaagaaggaagaaaaagtaatggaatttacaccgaaaaaccgtgcgaccgtccagaatatgccgaaacttccgtatgcggtagaggaagcactgaaccgtctgcgcgtcaatgtgagctttcttggaagcaaagtgaaaaaaatcatggtgatatccagcgctccggatgagggaaaaagttttattgccatgcagctgtggcgtcagatggcagaagccggcagcaagagcattcttgtggacatggatctgcgcaagagtgttatggttgacaaatatcagattgtccgggaagacaatggaaaaattctgggaacttccgattatctggcaagtgacgatacgctggacaaatatgtgttgcgtaccaatatcggagcgggagatctccttccgaataaagaaaatattattaacccgtccatgcttctcgaaggacagaaactggcaagtacttttgaagaattgaatgaaaattaccgctatacatttattgatgctccaccattgaatctggtatcggatggagaaaagatcggctcgctgtgtgatggcgcactgctggttgtccgcgcaggagaaacgccaaaggcaatggttcgtaattcgatccgccagttggagcgtgccgggtgtccggttgtcggcattgcactcagccgtgccaaaggcgctgcaaatggatattatcacaaatatggcaactactatggcaagagttattatggaaaaggctatggctactatggaaaacatggatattatggctatggcacagagcagaagtaggtgattccccaaaagggttttcacataaatcaatcatcagggaaaggaggattatatcccaatgaacaaattaatcaagaaggtgctggtaggtattaccgctgctactatgatgtttggatctgtttgtactgcttatgctgcaacagattctgcaacagtagctccagctccggaaaaacagacaaacgtcaaggctgataatggcgcaaaggtaagtaccgtagcaaacggtacagcaaccgtaaaggctttaccaaagacaacaaagaagagtgttacagtagcttctaaggtcgttgtagatggagtctcttacaaggttacagcaattggagcaaaggcttttgcaaatgctacaaaagctacaactgttacacttccagccagcatcaagaccattggcgctcaggcatttacaggtgcaaagtctgtaaagacaatcgtcatcaagtctgcttccgtaaaggttgccaagactgcatttaagggtgtaaacaccaaaaagatgacaatcaaagtttccggtatgtctgcaaagcagctgaaagcattcaaggctcagctgaagaaagccggattcaaaggaaccgtaaagaaagtttctaaataatctcgggttcttgaaaagggcgcacagagttgattctgctgtgccctttcctatagagaaaattgggaatgaacaaaagtaataagaatcataaaaatgaaagaaaggagacatcatgtatcaaaaagcaaaaaacagctggatcaaacatattgattttgtgatactggacattctgtgtctgcaggtttcttttttcctggcatatctcgtcagacaccggaatctgaatttatattccaattccgtgtatggaaaccttgccatcgtgttgatcctgattgatgtatgcatgatgtcctttttaaatacatgtaagaacgttctgaaacgtggactgctcatagaactggcggcaaccatgcgtcaggtcagcctggtgatactgtttgccgtgttttatctgttctttgtgaaagatgcgggtgatttttctcgtattacactgtttctgaccgctatcttttatgctataatcagttatgggacaagaattctctggaaacggcatgtattgcggaatctgcggcttggaagaaagaattctatcgtgatattgacagactgggccaatcttccacaggtgcgggaagatatccaacatcacagctatgaactgtttcagattcgaggaatcgctgtgatcgatgtcaatgaaaagaaaacacttcccgaaaaactgggggacatcccatttgtggcagagggcgaatcggtcatggattacttgtgccatgcatgggtggatgaagtatttatcgatctgcagcctgatgatccgcgggtagacagatggatcgaccagctgacggagatgggagtaacggtacatctgaagcttgccaaccggatggatctggcggcaaacaaacagtttgtggaaaatctcggacgatacacggtgctgaccacaagcatccgtaccgtaagtacctgggaattgtttctcaaacggttgatggatattctcggaggcatcgtcggatgcatcctcacaggaattctgtttctgatccttgcaccgatgatctatcatgaatcgcccggtccgatcttcttcggacagaccaggatcggaaagaatggcaagaaatttacgtgctataaattccgcagtatgtatctggatgcggaggagcgcaaagcagcacttgctgcagaaaaccgtgtatcggacggaatgatgtttaaactggattttgacccgcgcatcatcggcagcaggcgtctgccggacgggacgataaaaaaggggcttggaaataagatccgtgactggtccatcgatgagtttccacagttctggaatgtactcaaaggggatatgtctctggtaggtacacgtccaccaacggaagatgagtgggtgaaatacgagttgcaccacagaagtcgcctggcaatcaaacctgggatcaccgggatgtggcaggtaagtgggcgcagtgagattacggattttgaacaggtggtagcacttgatcgcagttatattgcgaactggagcctggaacttgatgtgaaaatattgtgcaaaacagtgggagtcgtgctgagacatgaaggtgcgatgtgagcggtaaaatatggaaaaaaatgatgaaaaattgtttgatgtataccatggaaaaaacaataattggcagtcatgcattagctatctacggatatttgcaacaatttgtgtaatttatcttcatacatgtagtacgttaagtgaaaatcaagaactatttgatttgagcaaaatgcaaaagattttctttaatgcatcatatcaaatgatgtattgggcagtaccggtattttttatgataacgggaatgctgtttttgagaaaagaaatgcatgttaaatccagtgagtggctctttaagtattcaaggagaattttgcttgctcttgttgtatttggtattccgtatgctgcattaaaattagtaatggcagatggactatcaattagcttattggataaggctattttagctttcttatcagatacaggttttggacatctttggtatttatatgctttaatcggaatttatttaataatgcccgtgttaaagaaatttgttgataatgcttcagagggagaaatacaattagtactttgtgcactatttgttcttgatttttgttttccgttattttctcgattaagtaatttgaaaattgcttttaacagccagtttttatatccggttttttatgtcttgttgggacattggttattcaaaaataaagagaaagttaatagaaaactaatcggaataattgcaataatttgtgtggcattgatttggattttaaatagcatgagttggaatccaaaagtttggacttcatatgacagtccagtaattggtgtgttagcagctgtagtatttttgatgtttgtatctaaggaatggagtgagaaattctggctttggagagtagatagattatgttttggggcttatttaatacatcctttatttattcagtttgtgtatcgattcctaaagattacaccaattcgttttaaaatttatccagtgatgacactgttattttgtttgatttttgtatgtttatcatttttagcatcctggatcatgcgaaaaataaaaattttaaaaaaatatgtattgtaaaaaggaattatattaatgagtgaatattcagttaaaattgttgtagcaactcataaaaaatataaaatgccgtcagacgcgatgtatattcctttgcatgttggtgcggaggggaaaaaagattccgatggaaatgagttggatttgggatatatcaaggataacactggggaaaatatttcaatattgaatccatcattttgcgaattaacaggtttatattgggcatggaaaaatttagattctgattatatcggtttggtacattacagacgctattttggaacaaaaaaaaggaatccgtttgacgggattttaacttataggcaattaaaaccaatgctggaatgttaccagatatttgttccaaagaaaagaaaatattatattgaaactttgtattcgcattatgcacatacacattatgctgaacaattggatttgacaaaagaaattttaaaggaaaagtatccagaatatgtgaatacatttgatgccgttgtaaatcgcacctatggttatatgtttaatatgtgtattatgagcagacaacttatgaatgaatattgcacatggttgtttgatattttgtttacattgaaacagaaaataggagaagataatctttctccttttcaaagcagattttatggaagagtgagcgagattatttttaatgtttggttggaacagcaggtaagggacaaaaaggtagagaaagatcagataaaagaactttcttatctatatacggaaaaaattaattggaaaaggaaaattgtttcttttatagaggcaaaatttattggaaaaaaatatgaagaaagtttttaaaaaaacatctgtgaaaaatttgtcaccatattatcagtttggaatcgattattttgggccatttctctatggatttaccaaatggttgtatacaagtctgaaaaaggcacagatacatcgcgtttattttttttccagagatggatatatgatggatctggcatttcagcaattaggatacgatgcggagtttgacacacaatatgtccatttttcacgcaaaagtctgagacaagcgttgctgtgtacaacaagtgggtatcaggattcgttgcagtatttgggatgggagaaatatgttacactttctaaattattggaatattatggatacgacgcaacagagagaaaacatctggcggaattgcataagtgggaactgtcaaaagattatgcatatgatggattgaaaaataataaagaagttgaacaaatttatatatgtctgaaagaacaaatttacgaaaaatcacagcaacaaaggcaattgctgctagcttatattgaacaaattggaatgaaaggatcttgtgcaattgttgatattggctggcatgggtcaatgcagtattgtttagaacagattgcaaaatataatggattggatttaaaaatttatggatattatattggaatctctcctcaatttccaatttgtggattttgtagtggatatttatataatccacaaaatctaaaacaaagaaagagtgttttatgttccttagggatcatggaaagaatgttacagagtaccgaaggctcaacggacagttataggcaagtaggagataagatttggccggtttacgcccactatgaatatgaagaagaacagaaactggtgtgttgtattaaggaatggcagcagggggctcttgattatattgaacaaaagaaaaattatttaaaagaggatgaggattatgtaaagtttgcacaaccgttgattgccattgggaaaaatcctacattaaaaatggttaaattgttttcttttttttacaatacagatggggaaaaagaatattatgtgagtcagaaaaagttagtacaatacaaaccgagggagttaatgcatgcgttaagcaatagtgtatggaaaactggatttctcaaatctgtgttcaagataccgtttccttatttttatatttacaggatatttagaaaatgaatcaagtaattgccgcttatattttaacacattttgatacgataagttttgatatatttgataccctgattgaacgcagcgtatcaaaaccaactgatatatttgaaattgttggggagaaagttttgggaaaagaacatcgccgggaatttctcgaaaacaggatacgtgcagaaaaaaaggcccgagagaaatcttgtgagattacattagatcaaatttatcaggagttggttgatacatataagtctgatatagtagaattgttacaaaagacagaagtgcaaatagaattggaaaactgccataagaaagaaacaatatttcctttttatgagcagtgcatacaaaaaggaaagagagttctgcttatttcagatatgtatcttccggaaaccgtgattgtatcaatgttacaaaggtgcgggatcaatgactatgagaaactatatgtatcaaacacatatgcagaaaataagttatcagggaaattatttcaaattgcgtgtaaggactggcaaatagatttaaaatccatgattcacatcggagatagtatcaaagcagatatgataggtgcgcataaagcggggattcatgtgtggcttgtgggaaggaaaaacagaatagaaaggctgatacaaagaatatgagcgataaggtattggaagtaaatgtcgatgatttgtatttgggaggagtgttttctttagtaaaaaatgttgtaaaaaataagccgaaggatatgcagattgatatagctgcaatcgaaaagtttacggataaagaaaatatacaaagttttgaaaaatgtggttcaaaggtatactatgtgggatatgatggaaataagtggcttaagcaattcatttgtttttttcatttgaaaaaactgattcgtgaacaaaattatacctgtgtacatattcatgcagatgtggcgaataagctgatggtatctggaatggctgcaagaactgcgggagtcactaaaattatattacattcgcatgcagcaggtgttgatggaaatcatcgatggttaaaggcgtggattcacagacgatgtcgcagattgcttaaatggatcgggacagattatgtggcatgttctgatattgctgcagaatggatgtttccaaatattgccgcaaaagagattactttgatacaaaatggaattgatttacagaaatttcgcttttcacagactgtacgtgaaatggtgcgtaaacaattacaaattagtgacgaattattgatcggtcacgttggaaggttttgttatcagaaaaatcatgacttctttctggaaattttgaaacaaattcgggagcgcggtttacatgcaaaattgttgttggtcggagaaggaccaaatgaaaaagcttttcgggagaaagtacatgcctgtggtttggactcttacgtcatttattatggtgttagtaagaaggttcatgaattgtttatggcgatggatttatttgcattaccgtcccattttgagggacttccaattgttggagtggaagcacaggcatctggattgcctgttatcttttcggatacgattacgagggaagcaaaaattacacaggcggtaagttatcttggaattgatgcccgtgatgtgtcaaaatggttggataccattattcattatgggaaagaaaaaagagatcgaataaaggcttatgatattctgaaaaatgcaaaatttgatattgtagatacggtaaatggttttatgaaactatatagaggataataggagtctaatgatttatattgcaacacataaaaagtttaatgtgccaaatctgaatgggtactgtgcattacaggttggtgcagagggaaaagaaaaatatgggtatctgagggataatataggtaatcatatttcagggaaaaatgcaaattattgtgagctgacaggcctttattggatttggaaaaatacagatgattcatataagggattggtgcattatagaagatattttggaagaaacaatcttagtaataaaatttccgatatctgttcatatgaatatttattgaattgcttgaaaagtgtagatatagttcttccttatgtagagtattttaagcaaaatgcaaaagaagaaattttgcttcattgttgtacggaagaaatttttgataaattacgtcagataattgaaacaaaatatccagattatatagaaacatatgatcgttattttaatgaaaataaggcatcgttgttcaatatgcttttttgcaaaagagaaatttttgatgcatattgtgaatggctgttttcgatcctatttgtgctggaaaaacaagtagacttagcaaagttaaatacttatcagcaaagattgtatggctttttgtcggagcggttgttgaatgtctgggtaattaaaaataaattggtggtaaaacatttaccggtgattcatatggaattacctgtttttgatcgtattcggcttgtgagaagaagatttactaacaggtttcgtttttggataaaacgtgggagtcaaagatgatatatgcaattatgattattttttcggtcataagtggttgtttggtaccttatgcagaaaagaaaaagaaaaaatccaagagcactatttacatgaaaaacatcaaaagaaatgggatgataagtatcagcctgttgtttccattgctggtttcttcgttacgctacggattaggaaccgattattcctatacttatattccgcagtttaatagtattgccaggggagataggggatattatgaaataggtttttatttattaaataaaatagtttcattttttaccaacgatggacagtggataatcgtaatttgttctattttgtttgttggaattgtgtatcgacagatttatagggaatcaaaagtatatgcgttatctattttattgctgtatctgacttttgcatattttgtatcattaaataatgtaagacagtcacttgcatctgcatttttattacttgcaatggaatgtctgtgtgagggcagaaaactagcgtttatagtctgggtattactttcagcatcgatgcatcaggtatcgttgatttttttattattattttttgcagatagaattatgttatctgcagttacatatttaattgtttcaatagtggcatttggagtgatgcagattatcggaggaagaattgtgcagctctttgccagatatattccaagattacagctatattttcaggcacaggagttgtcggcatatacaggtaatacgataggaagatattatattctaatgcaatttctgatcttgattttatttgtgtatattgaaaagaaaaataataaagtatttcagagtataacaggcaaggatcaaattgagtggaatattacgcttatgagtcaatgtgcacttttatgtgtgtgtgcattagatggaattgttccggcagcttaccgagttgtaagaattttttcatttgcgcagtttatattgattccaaatgcgatacgcaaatatgtaaacaacaaaaaagaaagaatgttgttgtatatggcaagtataatactatttggtgtgttgtttatattttatgttttgaatggggctgaacaggtattcccatacagatcaatatttagaaaatactagatttgtatttggtaaaggagaatagagagaataaaatcaaagatatgaaaacaggtttgctctttttactttaatagaatatggagaataaaacaaaaagtgaaggtttcaaagaataatttaaagtataattttgtatatagcatgatgtttcaaattttcaccatgataacaccatttataactgctccatatgtatcaagagtcttaggtcctgatggaattggaatacaaagttatactgggtcaatacaatcctatttccttttgtttgcagcactgggaaccgcgagctatggaaatcgagaaatatcgcaagccagagataataaagaagcatatagcaagaagttttatgaaattgagttgataaccgtattaacctgtatcgtatgtttactagcatggattgggttgatttttttcgataagaaaaatcaaatatattacattgcaatgattccatatatttttggggcaatgtttgatatcagttggttttataatggattagagaattttaaaacgacagttacatgcaatatgttgtttaaaacaattggaattgttgctatttttatgtttgtaaaagatgaaaatgatttggttttgtatatcttaattatggctataacaacaatgttggcaaatttatcgatgtggatttatttgccacgctatgtatgtaaaattacttttaaatcgttaatgcttaaggatcattttaaacagacgttaatgtactttattccaacaattgctacttcaatttacacagtcttagataaaacattaatcggggtaattacacaaaatgatgcacagaatggttattatgaacaagctacaaagattattaatatggcaaagagtgtttcgtttaatgcggttaatgcagttgtaggagtaagaatatcctatttatttgtagacaataaaatggaagaaataagagatcgtataagtaaatcgatagattttattttgtttatgacaattggatgtgggtttgggatagctggagttgcaaagattttggttccactcttttttggaaaaggatatgatcaagtaattactctcttatatatttttgcaccaattataacaattatcggaattagcaattgcctagggtcacaatattatactcccagtggcaggcggaatgatagtacgaaatatttgttgtgtggatctgctgttaatttaattttaaatttgtgcttgattggaaaatatggagctaatggagctgcatttgcttctgttgttgcagaattgagtattacttttttatatgtgaagaattgtaatgggtttatgaaacttggaaatttattaaggtgtatgtataaaaagatagttgcgggattattgatgttttttgtggtgataggtttggaaaattatctgcatgtgtcaaaacttatggttttgatttgtcaggttgtgataggaattgcaacgtatttgattgcattaatgatagaaaaagatgagtggatgcttattgagcttaggcggggagttttatattttaagaacaagaagggaagaagttgaaatgaatttagatgctgaaaagagagatggatattatatatctatggatatgaaaaaaatttggaatgtacagttaaagttgttgaaagaatttcaaataatttgtaaaaaaaataacattatatattatgcatgtggaggaaccttacttggagctattagacataaggggtatattccatgggatgatgatatagatattatgatgactagagatgagtatgagaaattagaaaaggtatccaatcaattctgttcgcaagtttttttccaaaatgcattgactgacaaaattgtgagatcccatgcacaattgagaatgaatgatacaacttgtctgttagttggagattatggtgaaaaatatcatagaggcgtttttatagatatttttattttggacaagataccaaatgatgaaaaaaagaaaagagatttatatagcagaattcttttgacatactctaaaatgacaaagccaaaatactatatggggagaaaacatccacatgtggcgaaaatgtatgaccatacaatttatgttattttaaaatttttttatcaagtaaagttaaatatttatggaggaaaaagaaaactctttcgagagtttgaaaaaacttgttctatttatcgaagtttagaggaacaattcaaataccagaatgtttcatttgaagtgactaattctttacgaaatgttttgtttgagcctgaatggcttagggaaactatagaagtaccatttgaggatattagtatatctgtgcctaaagagtatgatctgattttgaaagaacagtatggtgagtatatgaaatttgtggttggaaataataatcatggtggagtttatgttgatttaagtaacaattacacaaaatatgataaattatcaaaaaaaaattttttaaatttgtttgaaggaggaagtaaaaatgagtgatgtatgtgcaattgtattagcgggaggacaaggaacaagattcggggggaaaaaacagtttttggaaattaaaggaaaaccattatggaaacatgttcatgataaattatgcaaatttatttcagatgaggatattgttgttgtaggggttgatacagagggggggattacaagatctcaatccgtaattaatgggttgacgtatttaaaagaaaagggaaaagcatatgaaagagtaattatattggaagcagctagaccattgattacactagaacaaatacagaagattattaaggatgaacataaaagtactacgtatgcattgccattaactagtactgtggtaaagagagatggaagctatttaaatagaaatgaattatataaactatctacaccggtggcatttgattttgacttattttatgaagcatatacgtctggaaaatattttgattatacggacgatacgcgtattatgtatgaacaatatggaataaaaccattttttttggaaggtggtgaaaatatgttaaaagtgacttatcatagtgatctggcaattcttgaaatgttgatggaaaagtatgatttataaattttgaaattgagaagggagctatagtggaatgccatatgtaaatacacgaaaaatgctgctaaaagctcagagcgaaggttatgcgataggagcgtttaatatcgaaaatatggaatttgttcaggcagcaatcgaggcggcggaagaaatggaatcacctataattttggctacttctgttaatacattgaaatatgcgtcttcaaatatattttcttcaatggtaaaatcaacttgtgaaaattcagaaataccagttgctttgcacttagatcatggcgaaagctatcaagatgttattggagttattaaaagtggctatttatctgctatgatagatggatctaaacttacatatttggaaaatgtagagttgacagcgaaagttactgctttatgtggaaattttgatattaccgtagaaggcgaactgggggcaattggcgggaaaccaggagatttaagggtggaagaattaatgtatacagatcctgaaacagcaaatgattttgtacgaaatacaaaggtggattcattggcagtagctgttggcactgcgcacggaaagtataaatcaacccctaaattggatataaataggttggatcaaattagaaaaaaagttgatgtcccattagttttacacggggcatctggattgaacgacaatcaaattagaagttgtattaaaaatggtatttgcaaaattaatatagctacagaattaagatgtatttggacacaagctataaaaaaaagctatgcagagacaccggatatttatgatccaaagaatgcagctggggaggcaagaaaggcagttaaggaactgattaaaaagaagatttcgttgtttgggagtgagggaaaggcaaagtaagtagttcataggtttacatatttttattagaaaatctcttttttaattgcgagagcttgatattttactgctttcaaggataattaatttttaggcggctaaaattattttataattcctgcaaagggcgcttgccaactgcgatatgttttgataaaatagaacgaacgttcgataaataggtgcgcatatggggaaagagcacctataatttacattgtaaaaataataaaatgcaattataatgaaggagaagtgggatggcaaacgaggaacgtatcaacaaaatcatagatgagttgacactgtttgatgatgatctgatgagccgggtgtttgataagaatatcgaagcaacagaatacgtgttgcagatcattcttggaagaaagattaaggtggtaagtgtcaaggggcaggaaaatttcaaaaatccagttacaaacggaagaaatattaccttagatgtgcatgcagaggaagaagacggacaggaaattgacattgaggtacaaggtggagcagagggagcgcatatcagacgtgcccgttttcacagcagcatgacagacgcccggatgttaaagaaaaagcagaagttcagagacctgaaggattcctatgtgatctttatttataagcatgataagtttggaaaagggctgccagtgtatcatatcaatagacatatagaggaaactggggagttgttttcggatggttcacatattatatatgtaaatggaaaatataaaggcgatgatgaagtcggaaggttgataagagattttcatcaaagcgaagcggaaaagatagaaaataaggcattggcagatggagtgaaacatttcaaggagacgaaaggtgggagaaaacttatgtgtgaggcagtagaaaagtatgcacaggaagttgctgaagaaagagaaaaaaaggcggaaaagagaggagaaaaaagaggagaaaagcgcggagaaaagcgcggtatttcaagaggagagatacttaaaataataaagattacagtaaaaaaagtacaaaaaggctatacgatggaggccgtggcagaagacttggaagaaagcgtggataccctgcgcccgatatatgaagcggtagaaaaagcagcaccggactatgatgcagagaagatatatgagagcctcgacaaatagaagattgttttcagggcagggattcgtatcactgtttaaacaaaattgtatttttaatattaatccgttatactatatgcaaagtataacggatttttagtaattaaataaaactgtatatgcgtcaggagagataattatgttaacgattgtttatggagaggtcgatgaagcaattagcgaccccgatacttattttaatcatacctattcaaaaaaatggtttgatgacccttttgttaaggagatggtccgggcggtagacaagttggaggtattgtcatcccatgcaattgaaagtcctgttcttggaattattccgacaacaagattgtctggcggggtaaaggctcttatccttatttacaaaaagccagagttatggatagattgtactgcatgtggtgaaaattgtgccgaatggattcttaggattgcggaaaaacaggatactttgatcaatctgaattattttatggattttccggtgttaatgcgtctggtgtgatagaaaatatattgtgtggctccaattatgatggttatttatggaacaagatatttcaaaaaagaattatagaaaataataatttgaaatttctgaaaaatatagtggtctgggaagatttgttgtttgtattacagtacttgaaaaattgtagtacaattgcagtttcaaatgaaaaactgtattattatcggaatagagagggtagtgctgttaataataatcgactggacaaatatctatcgaaatataaagtgatggaggaaataaaaaagcaggactttacttgtacagaacaaagtaaaaagaaaacatcatttttatattttgaaacaatgtttagctacttgaatcagatccttattcgagaaaataaaaccaatgagctggctgaaatattgcccaatgtagatatcgtagaacttttaaagttaaagaacataaaactttttttgaaattcttgtatcttaagataaaagggaagctatataaaatatgaaggaacagaatttgtttgagactttacaaaggaagtcaactggggaaaacttatgggatgcagtatgtttttttcaaggaaacatttttaaaacttattcagggttagagtttacatatgaattgagaagaggacgaaacggagaatatacaaaggagttgagacattggggtcagaccctttgaaatactaataaaatgagtaaatatgttctaaaagttttctaaagaaagtataacataaagaaattacgaatctgtatgtgttaaggatgctcagttaaagcaatatgaacacaataaggagagatatgaacacaatattacttatcatggctgctggtatcggtagccgtttcggaacaggaattaagcagttggagccagtggatgatactggacataccatcatggattattccattcatgatgcaattgagactggcttcaaccatgtagtatttattatccgtaaggatatcgagaaggaattcaaagaggtcatcggtgatcgtatcgcagctatttgctctgctcataatgtaacggtggattacgcttttcaggacattaacgatattccgggaactctgccggaaggacgtacaaagccgtggggaactggacaggccgtgcttgcagcgaaggaagtaatcgatacctcgttcattgtgatcaatgcagatgattactatggcaaagaaggcttcaaggccgtccacgagtatctggtaaatggcggtgagtcttgcatggctggctttgtgctgaagaataccctgtctgataatggcggtgtgactcgtggtatctgcaagatggacgaggataacaacttgactgaggttgtggagaccaagaacatcgtaaagactgcagatggagcagaggtagatggtgtggcagtcgacgtgtattctctggtctccatgaatatgtggggcttgactcctgattttctggatgtactggaggacggattcaaagagtttttccagaaagaagtaccgggtaatcctcagaaagccgagtatctgatccccatcttcatcggtgagctgctggagcagggcaagatgtctgtgaaggttctgaagaccaacgacacctggtacggcatgacctaccatgaggatgtcgcagcagtgaaagacagcttcaagaaaatgttggcgaatggcgtgtataaggccgacctgttcagtgatctataaataacgatgaaagaaacgattgatttactcggcaagatcatcacaaacatcctgactgctctctatgaaccgtttggattctcactccttctttccttcctcgccccccaaaaagcaaaaataactcagaatagcgaatggcaggaaaaaagtcaagaattttttgaacatgagggataagggtgatagatatggaaaattcattatacatatatcatatggtggtgcctcttcgctactgtacttatgatttgcatagtaagaaaaagactcggaatatgtgatgggattaaagcagtattaaaaacatggtgtcaggaacatcgcattccagtctctacaatgaattactggatgcgcaaactgaaaacattggacgaacaatcggatacagctatgatttttgcaaaaatgccaacagaaaaagaaatttcaaagaatgagactttgaacatcgacccgtctccagtccgcatttttatcacaaacgctattcggattgaagtgatgccggaatgcccaccggaactttttcatgttctcatacagggactgaaagatcatgcttgatctggcaggtggcacaaccgtttaccttgcctgtggagctaccgatctgagaaaaagctatcacggactggctgcaattatcaagctgaaattcaaacttgatccctattcgcgctgcatgtttgcgttctgcaaccgcaggcggacttctattaagattctgcaatgggacggatctagtttctggattctgatgaagaggcttgacagggattcctttcactggccggaaaccccggatgaattacagaaagtgaccatgaaagaaatgcattggctgtgtgatggtctttcacttactccgaagggagcttttgaagaacgtcatccaaagattgttgtataaagaacggatttgtcaattcgcaaaaaatacgaaatactcgtggatatcgatatatattcctacagtaaaacgttgatttttctcgaagtaacaggcttttttatgttatacttgaattatcacttaagagtttggagattgccggatggatccgttttttacagaggaacagctgaataacatgagccgtgaaaacatgatggaagttatgagaatcatgcaaaatcaggttcggaaaaaagagaccggggtacagcttctgaaagacaagcagaaagaactggaatttatgaacgcaatgctttcagaccgtctctttgtatattccgttccaagtgtcaccggaatatacaaattctaaaaaagaacaaagaaagattcttaaactaatgcatgaggtcaagaatgatgaatcaatgatattagtagcaacaggttccctggtaggagaaggtttcgattttccaagactggatacactttttatggcaacacccatatcattccgtggggtagttgaacagtatgcaggacgattgaatcgtgattatgcaggtaaagaaaatgtaataatatatgattatgtggataatcgtatcccaatgtttgataatatgtatatgaagcggctgaaggcatataaacagattggctacgagctttctagtggcttgaaagccgataaacagatagttaatgcaatatatggggggagataattatagagaaactttccataaggatctacttgatgccaataaaaatataatcatttccagcccagccatcagcggacaaaaagtttatgaattaatcagcatgctaaaggaaaaacaggaggcaggagttcagattacaatagttacatggatgccggattcatatggatttggtgatgcagcatattggatgcagctacatgaagatatgcgtaaagctggcttttatataaaaacagtagaagaatattgtgaccgttttgctgttattgaccagaaagtagtatggtatgggaatattaatctgctggcgaaggataagatagataatagtattatgagagtcatgagcaaagatatagcaggtgaattgatggagatcacatttggcgataatgatagagaagtaaggtgtaatgtaaatgactgaacaagaatttaaagaaatattacataaagaggaaacagatacagttgaatttaagtcttgggttaatgcaagaaatatgaaggaaattatatcgcttgcggttgatgaattgatagcatttgcaaatagcaagggtggaactgtttattttggagtagaagataatccggttgtggttacaggatgtgatagaaactatgatgggcaacgaattatagaggggatttatgatagaaccattccaccactattcaccgaaatatcagattttgagtatgagggaaagctcgttattgcaatatcagttaaagcagatggaaagacgtatacaactacggatggtagatgcctgaaacgattggggagaaattcaaagccagcatatcctgatgaattaagtgctgtatattcttctgttcagaatccggatttttcaggaagaattattggagagagtactctggatgatgtaaataaactggaagtgtacagcttaaaggaaaagctgagagtcagagattctaaatctacattgccggatttggaggatattgagtttttaagagatttacaacttgtaaaatatgatggagatgtagaaagactgacgattgctgggttactgttcgttggaaaagaagcatctattcaaagattgttaccgcaggcggaagttatatacctacattattcagctgataatttggaggaatatgatgcaaggctagatttgaagttgccgttgataagcgttatcgacaagttgacagagcgggtacaggcatacagtaagatagaaaatattcaggtaggattattcagacttgaagttgaggatttccctgaaagagtatttcaggaagcattgcttaatgcgttgtctcatagagactaccagagtaatgctgcggtttatgtaaaacaatacccagatcgaatagttattgaaaatccgggaggatttcttgatggaattacagaggataatattataactcatccatcgattcccaggaataaactaatagcggagacacttcaaaatttgaagtatgtccagaggacaggtcagggagtagatattatttataaggacatggtttcaatgggcaagccatatccaagatatagatcatttaatgatgcagtttcgcttacaatatttagtgcaatagataatactgaatttgttaagtttattacagaagtacaagataaaaatagtaaaattatgtctttggctgagatgatgatattaagagatcttttagataacagaagggaacagttatcagagttgtcgagaaaagtccaaaaatctctggatgaaacgaaaaaatcatgtaatgaactgattagtagtggattaatagagagtgttggaaaggaatacatgctgacagctaaggtttatgaagcattaaagtcagatgtggaatatacaagagataaaacagtccagtatatcaaagctaaaaatatgattttagagtatttacagacgaatgaccagataacatctgctaaaatacaggaaatgtgtggatttactaaacaacaggcaagaagtgttattgacaagatgagaagtgagaagttaattaacttaaatggcaaaggaccggcggctagatatgttatatttgatggattgagtgataattgagtttggggtaaaataaaactcaatagaaaactcaattacgtttaatggcaagtactggagtaatgaatacgatgaaaatatgattgagtggagtctttttaaaaactcaattaaaactcgttgatgtgcgaaaaaatcacattggcgggagtattggaaatccatgtagaaccggaacatgtgaaagtatatacagtttatcggaatgatacacaacgtagaacctatggagaagacagaatggaatgcaaaacaagtagagatttcttttgtgaatacaattcagtggtcgggatggaggtccgatattatctacagggttataaaggtacgctgattaccgatggctatcagataagttctcaattgtgagtaccacaacataagatccaatgatttatcgtatcctgaaaaatccaagtgactatacagagtttttattaaacagtaatattaattttgacaggtgcatggtataggaaaaaaggatgagataaaaccagcgtctaagcccgacacataaagaaaggagaacgaaaacgatgaaagcattaaaaaaacaacaaattgcggtcattttgatactgtctgtcatactcagcacatttgcagctgttacacctgtaagtgcggcgacgctgtctgcacagcagtatttggaaaagatggatatagcggtgcgaaacttaaaatcatatgattttacgcagacaaccgatcagaagatgacaatggaagggcagatcattcaaaataagacggtggtaaagcaaagcgtatacaacagtcccctgaaggtaaaaagcgtaacagatacaaccacagtacttgcaggaatgagttctaagaaccaggcggttgcctatctgacaaaagatgcggatggattgctgtgggagtacatttcttccaatggttccggatatcagaaaacagggattttaaactataccaatcagatcaaaggtatggatatttccatgtattcggatgcaaaaattgtgaaaaagaaaataaaagtcaaccggatcaataccgttcagatttcggcgcaggtaaagggctccgatgtggtgaaatttttggaccagatgggaatgagcaaagagatcaatgcggcagctgctgtggattacaatacgttgccggcaatcaaagtgacctgttggattgataaaaaaacctgtcgtccagtcagaaccacggcggatatgaaagcgtttatgaacgggtatatgtcggcgctgtatcagaagctgggacaggatctgaaacttgtttattcgcaggcaaaagcaacggtaacctataaaaattttaataaggctgcaacatttaccataccgaaggaatgcagataaagataccacattttcaaagatgacaacaacagttactacggatacaaataaaataatatatacggcaaaggttccgaaagacgctacatctgcacggtaagtattcggttggaacatacacctatcaaaaataaatgtttctgagaagagagaatggctgtttgcgaaaacggctattctttttttatctaaaatggcatatttcttgtcagaagcaattgaaattataattcaaatatgataggataaagtaggctgtctaatgtagaaaagacacataaggcagagtgggggatatatgtaatgtcagagaatgatagttactacatataaaattataaaactacggaggaagaaacatgaagaacaaagattatttaacagtaagacaggaagaattaatgaattttctgtggaaggtcaatgagccgctgactgccaacgagatggcagagcgcctggcagaagacggatggaacaatgttacattgtttaagaccgttcagtctctgacaacggatggctatctggaagttgtaggacttgagaaaactgtcaagacttatgcacgtaaactcgctccgtctatgtcaaaagacgattattatgcatctgtattgattaagcgtggaattgacagcagttctattgcgaacattacagctgctctgatcggagcaaaagataagcaggcaaaagaaaaaaatgcagaggttattgcaaagttagaggagattattgatactctgaaaaatgatgaggaataagaatgcaaataacgatattttcggtttggatgacgttcgtttggtgtaacatttttattgtactgtgctacattctcagaaaacgatcggttctgctgaatttatccagtatgacaggaatcatcattttatatttgttttgtctgatcaggcttgccgtcccggtggaattgccatggacgaaagtggtatccggaggcagcctgtataatttcctgtatcagatattcgggtgtgaaataacctgtgtggcagggcacgaaatctatgtctatcatatatttgtggtggcatggggagtggtcatggcagttcttttgacgcggtatctgatacagtatcacagagttgtgtcgtatttttcagagatggaaaaaacggaagatacagaattaaataatattttagatgaaatttgtacggataaagaaaagcggaacattaagatcgtacagacagcagcggtagaagtaccgtgttgtattgggacttttgaaaaacggatattaattccggacaaaaaatattcgcgtgaagaattgcattatattattctacatgaatatacacatttggataataaggatatactgacgatacagctgatcaacattctgtgtatcgtgttctggtggaacccgtttgtgtatattttaaaaggagatatgtatcagagtattgagatccgttgtgaccagacggttacaaagaaactcaaatcggcagagcggggtaactatctgacggtgatattaaaagagtataaggcaagtgtgcaggaaaaagaatttcgaaaacctgcaggagccatgccgttgtttgaagatcattcggatcatctgatcgaacgatttcgtctggtcgcggagggaaagcaaagtagttcgcgtattggaagaattcttgttccggtgattgcggttgctctgttggtgctttcgtattcaataatacttcagtctagatatgaggtgccagaaagtacttataaggttccgaatagcagctgttgggaagtgaatcagaagaatacatacctgtttgagaaagatggaaaatattatcttcacagtaaacagaaaaattatctgattgataaaaagtcagcagagctattggagaaaaatgaatttaagtttcgacaaggaggaaagtaacatgaaaaagaaacttttaattgcagcagctatttgtgcatctttatttgttgttatgccaatgacaaatgtaagtgcggcggaagtggacgcggaagcacaggggcagagtgcccagagcgatattgctgttacaccgtgtgcggatgagattgtgacaaaatttcgcatgctcaatggtcatttacagtatcgtcgttggaatcagaccagaggatactgggtggataagaagtggattgatttaacttaattaaagaatttgccggtgcagctgcaccggcatttttttacaaattattctttcgcaaattataattcttccggcagttcccacgcctgtgcctgttgttcatattccgaagcacgggagagaagatccccggcagagcatggatcacagagctcattttctgccagcgtacggtaacattccgccagttgaagcaatgcttttttccctgaaatttcaatatccagaacaggctgtgtctcaaatgcagcattataaaaccacagagaagcttcctggggattctgccgttttcggtagtattgtccgatctcataacagatttcggagcaggaagaaccgcacatatctttcagacagatcgaaaagaaatcatccacagaattttggatacgcgcagcgtgcgccagaatacacgcggattctgcatcagcgtgcgcttcatagtgtatcgaaaaataatctgcggcgcgcagaaaatcttcctcatccccacatttataaagttctcttgcatacatgcgtgtgattttctccgagaggacatgattttcacgaaatgctttttcaaacatggcaaaatcccgtttggcatgcatggcatgtggtcggtgtagaatatcaatatcactgtcatagatgacgggatcggtgcggatcgtttcgtgaaccggatcgacccatgaaaacgtgcgcaggcgtttaaaaagttttggacgtggctcttttttacagttctgcacggtgttgaaatccggtggggtgatatagttcatctgaacaatttcaatttccggaagaagagcaccttttaaccggagaaaacgtctttgattttccagatcaaggtattcgtccgcatccggacagtagatgtaatccatggttgcaagcgaaaacgcataatttcttgcggcggagaaatcatcacaccaggtaaaatcatagatccggctggtgtattgtgcggcgatttctttggtgcgatctgtggagccggtatcaacgatgatgatttcgtccatcatggaagcaacggaatccaggcatcttgccagaaccggttcttcatttttgacaatcatacataaacttattgtgatcataataacagatggtccttccgaggtttttcttttatattacactatcctgcaacagttttacatagaaataaagaaatatacttgtatcttttttgaaccatggctataataaaatttatgtggtgtgaaattataaaacaaattttggcagatatgcgccagccgcttcaatatgtgccatgggcactggttattgtggtacttgggctggttgtaacaatcgtgctttctgaaaaaaaggacggaaaaaaagcatccgtccggttttttcgtatactttttgcgatttatatacttgtggtgatacagattacctttttttccagagaacccggttccagaaatgggtgcatgaatctggaactgttttccacgtggggatacagcgtggttacccatgcattttttattgaaaatattcttatgacagtgcctttcggaattctggcaccgctttgttttcgccggctgcggccgatgtggaaatgtgttgtactcggaggtgtctgttcggttctgacggaactgagccagtacgtgacgaaacgcgggtattgtgaagtagatgatatgctgaccaacaccataggtgttttatgtggttgcattttgttatggctgattgaactgataataaaacaaaggagaaagaaatgaagtatgattatctggtggtaggagcaggattatatggctccgtatttgctcacgaggcagcaacaagggggaaaagagttctggttgtcgataaacgtccgaatattgccggaaatgtttatacggaggacattgagggaatccatgtgcacaagtatggtgcacatattttccataccaacaataaaaaggtgtgggattacattacaaaatttgcggaatttaaccgctttacgaattcaccggtagcaaattacaaaggggaactatactcgcttccgtttaatatgtacacctttaataagatgtggggtgttgtgacaccggaggaggcagcggcgaaaattgaggagcagaaaaaagccgcaggcattacagaaccgaaaaatctcgaggaacaggcgatcagtcttgtgggaaccgatatttacgagaaactgatcaaaggatatacacagaaacagtgggggcgtaagtgtacggatctgcctgcttttattatcaagcgccttccggtgcgcctgacgtttgataacaattattttaatgcgctgtatcagggaattccgatgggcggttacacaaagatggttgagcatctgctggagggaatcgaagtccggcttgggattgattatctggagcagaaagaggaactgaaggctctggctgagaaaacggtatatacgggagcgatagatgcgtattttgattattcgctcggcgcgttggaatatcgttccgtgcggtttgaaacagaacttctggatactccgaatttccagggaaatgcagcagtcaattatacggatgcccagacgccgtggacacgtattattgaacacaaatggtttgaattcggcaaggatgatgagggacatgatttaccgaagactgtaatttcgagggagtacagttcggagtggaaaccgggggatgaaccgtactatccggtaaacgatgaaaagaacggagctctttatcagaaatataaagaacttgcggaaaaggaaaaaaatgtaattttcgggggaagactcggagagtataagtattatgatatggacgctgtgatcgcttctgcactggaaatgtgcgaaaaagaactgggataggcttctagaaagatacaaaaaagagcattcgctgtatggttacagctggaatgctctttttgttatacatatttgtccagcatcattccggaatagatggatgtgatgtatggggttgcaaagttgtgaccgggatttttataggccacgactatcttgttgacatagttcatcggattgatggagatattttccgcttcttttccgatggaatcccgaaattgggataaagtttcaaatgtattctgatcacgttccggaacaactgcttcacggagcgcttctttatcaatagagatggagccgttctcgtttgtgaccagaccgatgtcctgtaaagaactccggcttgaaccggatatggaaagaatctctgtctgaagtttgtttccggcactggcattggtgtctgcatacacggctgcggtggaaagtatggaattataggcatccaccagagactggatattgtccgcaattgcatccgcatctgttttaaatccaatgtttactttctcactatcggttggctgatttaaggtcagttcaaatacctgattgatggaaaatgtgttggtcagggaagagtggcttgtgccattcagtgtaaaggcggaactctgtgcaggggaagtgatgcggtcaattcccagctgatccatgatttccgtggaacctgtgctggcatccggtgcaatggaaaaaagttcggtttcgttatctgccagaccggtctgtatggaagtcagtttcagcgcactcgaaccgtttccatcggacagtatttcggcggtaattccgagactggaggagttgacaagcctggccagcttgtccagcacatccagattggtttcgtcggaattgatattatattgaaattcatatgcagcaccagacgtattcagatcaaaagaatatgcgccgggacgcatcgacagtgtattgtcttttaaaaaacgtccctgattgatctggggtgtggcaagccgctgcacttcaatgtcaaagttattggttttactttcttcacttccgtcgccgatataggtcacactgactttttcgtcatcggaagacatggcaactttcttcttaaaagaatcctcaaatgaaccgtactggtcggaaagagatgccacaacgttctgaatggagcgcgcgttttccttgatgtctatggcatattttttcgcatcggtgagattcggaattttataaagaggcgaatctttatttattttgacaattttattataaactttgcgcagttcacttttcttgtgtgaatcataacgtgaaaccgttttctgggcatacgtcgagatataataagcgtaggcattatcaatccttgccattgagattcccctcctttcttccgtgaattgaggattaagagcaggacagtaacagacctgttctcctgtgaggtgcatatcctttgcacccaaaaagattctacttgaatagtatatcggcatcataccgcattttccatacccttgtatatggtaaaattttactaaaaattcacaatttggcgtaaaagctgcaaaaaaccataaaaaccattgtaaaagatgttgacggacatggaaaatcatgatatagtatgaaagcttggaagtaggtcttttttttatgcctttttttaggcgggacaaaacacgaaaattaataacggaggtggaagttgtgcgtacaaagattacattagcctgcacagaatgtcagcgtcgtaattacaacatgacaaaggacaagaagactcatccggacagaatggaaaccaagaagtactgtagattctgcaagactcatacagttcataaggaaaccaaatagtccgtacagagcaaaggagttatgaaatgggacagacagaaaacgttgaaaaggctccaaagacaagctggtttgacggtgtaaaggcagagttcaaaaagatcatctggccggaacagaaatcagttgtcagacagaccattgcagtgattgttacatccgttgtagtcggtcttattattgcactgctggattgggcaattcagcacggtgtgaatttccttgttggtttgaaattttaacggaggcatagtgatttatggcagaggcgaactggtatgtagttcatacctattcaggttatgagaacaaagtcaaagcgaatattgacaagacaattgagaacagacatctggaagaccagattttggaggtccgtgttcctcttgaggaagtgacggaagttaaaaacggagtgaaaaaacaggtttccaagaaaatgttcccgggctatgtgctgattcatatgattatgaatgacgatacatggtatgttgtccgcaatacccgcggtgtgacagggttcgttggaccgggaagcaaaccggtgccactcacagatgctgaaatgagaccgctcggaatcaaggctgaaaatgttgtggtggatttcgcagaaggcgacatgattgttgttatcggcggtgtctggaaagatacctgcggtgtgattacagcgatgaaccataacaaacagacggttacgatcaatgtggatctgttcggtcgcgaaacaccggtagaagtaagtttcgcagatgtaaagaagatgaattaaggaggcaattccaatggcaaagaaagttgaaggatacattaagctgcagattcctgctggaaaggcaacacctgctcctccagtcggaccggcacttggacagcacggtgtaaacatcgttgagtttacaaagcagtttaatgcaaagacagccgatcagggcgacttaattatccctgtagttattacagtatatgcagacagaagctttagctttattactaaaactcctcctgcaccagtactgatcaagaaagcctgcaagatcaagtctggttctggtgaaccaaacaagacaaaggttgcaaagattacaaaggcacaggttcaggaaatcgctgagctgaagatgcctgacttaaacgctgcaaatatcgaagctgccatgagcatgatcgctggtacagcaagatctatgggtgttgaagtagtagactaatctaagtttaagaagaaatgtgggagggtaattgatttcccacccgatattaccaccaggaggtttatatttcatgaaaagaggaaagaaatatcaggacgctgtaaaggcatacgatagaagtgctcagtatgatgttgctgaagcaatcgacctcgtaaagaagaatgccacagcgaaatttgatgagacaatcgagcttcatcttagaacgggctgtgatggacgtcacgcagagcagcagatccgtggtgcggttgtactgccacacggaacaggtaagaccgttaaggtattggttttcgcaaagggaaccaaggtagacgaggcacaggcagcaggagctgacttcgttggaggagaggaattaattccgaagatccagaacgagggatggttagacttcgatgttgtagttgctacaccggatatgatgggtgttgtaggacgtctgggacgtgtccttggaccgaagggcttaatgccaaacccaaaagctggtacagttaccatggatgttaccaaagctgttaatgacatcaaagccggtaagattgagtatcgtttggacaagacaaatattatccacgtgccagttggaaaagcttcatttacaagtgagcagttgaacgacaacttccagtctcttatgggcgcaatcaacaaggctaagccttcaagcttaaagggtcagtacattaagagtgctgtattaacttctacaatgggacctggcgtaaagcttaacgttgtaaagattgctcagtaatagaaaaatcagaagtcgggaaccggaaacggttcctgatgaaatgataaaatgtatgatcagacttacacaagcaaaatgcggaaaacacttgacatccgcataagaacatattataatagcaaagcatattgccgaagacagtaaggtgctatcgcatattgcgacagcgtaaagggaaatccacctaccgagggaatttttgatgataatcgtcataaagaatgatacccctctgctgtaaggcggagggtttttattatacctcacgctatatgcaagaaataaaataaggaggtaaatgaatcgtggcaaaggtagaattaaagcagccgatcgttcaggagatttctgaaacaattaaggacgcacagtcacttgtagtagttgactaccgtggacttacagttgctgaggatacacagcttcgtaaaaatttaagagaagctggcgtaacttacaaagtatacaaaaatactttagtaaaccgcgcaatcgagggaacagagttcgagagcttaaaggatgtcctggaaggacctaacgcatttgcagtatctacagaagatgctacagctccagccagagttctggcagagttcgcaaagaaggctccaagccttgagatcaaggccggcgttgtagaaggaacatactatgacgcagagggaatgaagcagatcgcaagtgtaccaagcagagaagtacttctttccaaattacttggaagcttacagtcacctatcacaaatcttgctcgcgttcttaatcagatcgcagagaagggtggcgcagcagatgcagcagcagacgcagcaccggctgaggaagcaccagcagcagaataattattaaaaataaaattataacggaggaaataatcatggcaaagttaacaacagcagagtttatcgatgctatcaaagagttaagcgtattagagttaaatgaccttgtaaaggcatgtgaagaagagttcggcgtatctgcagcagcaggcgttgtagtagcagcagcaggcggagacgcagcagcagctgaagagaagactgagttcgacgtagagttaacagaagttggaccaaacaaggttaaggttatcaaggttgttcgtgagatcacaggtcttggactgaaggaagctaaggacgctgttgatggcgcacctaaggtaatcaaggagcaggctgacaaggcatctgctgaagacgctaaggctaaacttgaggctgaaggagcaaaggttacattaaagtagtctgtgcgtaagcgacgagaaaccaataataacccggcagagatgcttgcatttctgttgggttattttatttaactgtatcccctctctctatctgaaaaagttctcaaaaataattcttgcatttcccttgattttgttgtatagtataagttgcactattgtggtgcactaggcatttccatgctcttttttaggaaaaactagattgaaataaaaacgagaggtgaaacgtcaatggagaaaaacagaatacgtccagtcaaggctggaaaaggcttgcgtatgagttactcgagacagaaagaggttttgcagatgccaaacctgatcgaagtccagaagaattcttatcagtggttcctggatgaaggtttaaaagaagcatttgcagatatctccccgatcacggattacagtggtcatctgagtctggatttcgtcgattttacactgtgcgaagacgatgtgaaatatacaatcccggaatgcaaagagagagatgcgacatatgcagcacctttgaaagtcaaggttagacttcataacaaagagacagatgagattaacgaacatgaaattttcatgggtgatcttcctcttatgacagagacaggtacgttcgttatcaacggtgcagaacgtgtaatcgtcagccagttggttcgttcccctggtatctattacggaattgctcatgataaagtgggtaaaactctttattcatgtactgttatcccgaaccgtggtgcatggctcgagtatgagactgactccaatgacgttttcagtgtaagagtagatagaacccgtaaagtgccgattaccgtattgcttcgtgcacttggtgtaggtaccaaccagcagatcattgacatgttcggcgaggagccaaagattctggcatccctgcagaaggacccggcgatcacagagcgtgagccacagggaagctttgaggctggtttattagagttatataaaaagatccgtccgggtgagccgctttccgtagaaagtgcggagagtctgatcactgccatgttcttcgatccgagaagatatgacctggcaaaagtaggacgttacaaatttaataagaagcttgctttaaagaaccgtatcaacggacaggttctggcagaggatgtactggatccttctaccggagaagtaattgcagaggcaggcacaactgttgaccgtgatctggcagatcagattcagaatgctgcagttccggcgctctggattcagacagagacacgtaacgtaaaagttctttcttctatgatggtagatatcagaagctggattcctgaaattgaggacccgaaggctattggtgttacagaactggtatattatccggctctgcagcagattatggaagaaaacgagacattggaagagcgtatcgctgcaattaagagagatattgcagacctgattccaaagcatattacaaaagaggatatcttcgcatccatcaactataatatgcatctggagtggggcatcggaacagatgacgatattgaccacttaggaaaccgtcgtatccgtgctgtcggtgaattgttacagaaccagtatcgtatcggtctttcccgtctggaaagagtggttcgtgagcgcatgacaactcaggatcttgagggaatttccccacagagtctgatcaacatcaaaccggttacggctgcggtaaaagagttcttcggatcttcccagctgtcacagtttatggatcagaacaacccactgggtgagctgacgcataagagacgtctttctgcattgggacctggcggtttgtccagagaccgtgccggattcgaagtacgagatgtccattattcccattatggacgtatgtgcccgattgagacgcctgaaggaccaaacatcggtctgatcaactctctggcatgctacgcaagaattaacgagtacggatttgttgaggctccgtaccgtaagattgataaatcagataaagacaatcctcgtgttacagacgaagttgtatacatgactgcggatgaggaagataattaccatgtagcgcaggcgaacgaaaaactggatgaggatggacattttgttcgtaattccgtatccggtcgttaccgtgaagaaacgcaggagtacgataagactgcattcgattacatggacgtatctccaaagatggtgttctccgttgctacagcactgattccgttcctgcagaacgatgatgcaaaccgagcgctgatgggatctaacatgcagcgtcaggcagtgccgcttcttaccaccgaggcacctgtagtaggaaccggtatggagacaaagacagcggtcgattccggtgtctgtgtacttgcaaaagaagcaggtatcgtggagagttctgagtctaatcgtatcgtagtacgtgaggaggacggaaatcgcagagaatatattctgacaaagtttgcacgaagcaaccagtccaactgctacaaccagagaccaatcgtgttcaagggacagaaagtagcaaagggtgaggtgatcgctgatggaccatccacatccaatggtgagctggcacttggaaagaacccgctgatcggcttcatgacatgggaaggttataactacgaggatgccgttcttttgagtgagcgtctggtagagtatgatgtatatacttctgtccatattgaggaatacgaagtagagtctcgtgatacaaagctcggaccggaagagattacaagagatgtaccgggtgtcggtgatgatgcattaaaggatcttgacgagcgcggaatcatccgtgtcggtgccgaagtccgtgccggagacattctggtaggaaaggttacaccaaagggagagacagagcttaccgcagaagagagactgcttcgcgcaatcttcggtgaaaaagcgcgtgaggttcgtgacacttccctgaaagtgccgcacggtgcatatggtattgttgtagatgccaaagtatttaccagagaagatggcgatgagttatctcctggtgtaaatgagtctgttcgtatttacattgcccagaaacgtaagatttctgttggtgataagatggccggacgtcatggtaacaagggtgtcgtttcccgtgtattacctgtagaagatatgccatatcttccaaatggccgtccacttgacattgtattaaatcctctgggtgtgccttcccgaatgaacatcggacaggtgctggagattcacttaagccttgctgcaaaggcacttggttttaatatcgagactccggtattcgatggcgcaaaagagattgatatccaggatacactggaacttgcaaatgactatgtaaacatgccgtttgatgcagaggaagcagaagacggagaagaaaacttctacgataagtataaagatactctgagagaggacgttatggattatctttcagagaatcgtgcacacagaagtctgtggaagggtgttccgatttcccgtgacggaaaggttcagctgcgtgacggacgtaccggagaatacttcgacggaaaagtcacaatcggacacatgcattatctgaaactgcatcatctggttgatgataagatccatgcacgttctacaggtccttactccttagttacacagcagccgctgggtggtaaagcacagttcggtggtcagcgattcggagagatggaggtatgggcactggaagcttatggtgctgcatatactctgcaggagatcctgactgttaagtccgatgatgtcgtaggacgagtaaagacatacgaggctattatcaaaggcgagaatatccctgagccgggtgttccggaatctttcaaggtacttttgaaagagttacagtctcttggtctggatgtcaaagtgcttgacgaagacagaaatgaagtagaactcattgaaaccagtgagtacggaaataccgatatcaatgccatcattggaaatgacagagatgacagagattatgcatttgaagacagtgagtcgtttgaaaaacacggatttaccaagcaggagttcgattccgagaatgaagagcttgtcaatgtagaaccggaaaatgataacgatgatgaagatttcggcgatgctgatgatctctttgatgacgcagaagaagttcttgatgatgaagagtaattgggaaggagtgtcataaatgccagaaacaaataaaaaggacatgaatcaggcaatgcagtttgatgcgatccagattggattagcatcacctgagaagatccgtgagtggtctcatggcgaagtaaaaaagccggagacaatcaattacagaaccttaaagcctgagaaggatggtcttttctgtgagaaaatttttggaccgcagaaagactgggaatgtcattgtggtaaatataaaaagattcgttataaaggtgttgtctgcgaccgctgtggtgtagaaattacaaaatccagtgttcgtagagagcgtatgggacatattgagctggcagctccggtttcccatatctggtatttcaagggaattccatcccgtatgggtctgatccttgatttatctccgcgtgtacttgagcgtgtgctttatttcgcttcttatattgtgcttgatgcaggagatacttctcttgcatacaagcaggtactttctgaggcagaatatcaggaagcaagagagcagtacggaagtgcattccgtgtgggcatgggagcagaagccatccatgaactgcttgctgcgattgatctggaaaaagattctgcagagctgaaagcagagttagagaatgcaacgggacagaagcgtgcacgtattatcaagcgtctggaagttgtagaagcattccgtgagtccggaaataagccggagtggatgatcatgacggttatcccggttattccgccggatttacgtccgatggttcagctggatggtggtcgttttgcaacatctgatctgaatgatctgtatcgtagaattattaaccgtaacaaccgtctgagaagactgcttgatctcggtgcaccggatattatcgtgcgcaatgagaaacgtatgttacaggaagcggttgatgccctgatcgataatggccgtcgtggacgtccggttaccggtcctggaaacagagcactgaagtctctgtctgatatgttaaagggtaagggcggacgtttccgtcagaacctgttaggaaagcgagttgactactccggacgttccgttatctgtgtagagccaaaacttaagatctatcagtgtggtctgccaaaagagatggcaatcgagctgtttaagccgtttgttatgaaagaactggcagctaaaggaattgctcataatatcaagagcgccaagaaaatggtagaaagacttcagccggaggtttgggatgtgcttgaagaagtaatcaaagagcatccggttatgttaaaccgtgcccctacactgcacagacttggtattcaggcgttcgagccaatccttgtagaaggtaaggcaattaagcttcatccgctggtatgtaccgcgttcaacgccgatttcgacggtgaccagatggctgtgcatcttcctctgtccgtagaagctcaggcagaatgccgttttatgctgttatcaccaaacaacctgctgaagccgtctgatggtggtccggtagccgttccttcccaggatatggtcctcggagtatactatctgactatgcacaaactggcagattataaggataaaaaagatgcagttgctgtttccgataaagtgtataacgatattgaggaattaaagaaagcaaccacaccggacccgaagacaggaaagagtgagatcggattgtatgatctgatctggtttgaagatacaacagacaataaccgtcgggtattatgtaagccaatggatctgtttggatatcattacggaagcatgaatcaggcattgcttgcgtatgagaatggagagattacacttcatcagaatatttatgtataccgtaaggcaactatggctgacggaacagaagtatccggatttatcaagacaacacttggtcttctgattttcaatgagatcattccgcaggatctgggatttgtagaccgcagtatcccggagaatgctttgaagctggagattgatttccatgttggaaagaaacagatcaaacagattctggagaaggttattaatattcatggtgcgacaaagactgccgaagtactggatgatgtcaaggcaatgggttatggatattccacaagagctgccatgaccgtatcaatttccgatatgacagtgccaccacagaagccacagatgatcgagcaggcacagaatacggtagaccggatcacacgtcagtataagcgtggtcttatcacagaagaagagcgttataaggaagttgtagagacctggaaagagacggatgatgagctgacaacagcacttcttaccggacttgacaagtacaacaacatcttcatgatggccgattccggagcccgtggttctgataaacagatcaagcagctggccggtatgcgtggattgatggccgatacaaccggtagaaccatcgagctgccaatcaagtcaaacttccgtgaaggtctggacgtactggagtacttcatgtcagcgcatggagcacgtaaaggtctgtccgataccgcacttcgtacggccgattccggatacctgaccagacgtctggttgatgtatcccagcatatgatcgttcgtgagtctgactgttgtgcaggaacaaatcgtgagattccgggaatgatcgttaaggcatttatggaaggcaaggaggaaatcgaaagtctggaagaacgtattaccggacgtttctcctgtgagacaatctgtgacaaagacggaaacgttattgttaaagcaaaccatatgattacacctcgccgtgcagcggatgttgtgaataagggtgttgatgagaacggaaatccgatcaccagtgtgaagatccgtacgattcttacctgccgttcccacatgggagtctgtgcgaaatgttacggtgccaacatggcaaccggtcaggcggtacaggttggtgaagcaattggtattatcgccgcacagtccatcggtgagcctggtacacagcttaccatgagaacattccataccggtggtgtagccggtaacgatattacacagggtcttcctcgtgtagaggaaattttcgaggcacgtaagccaaagggacttgcaattattacagagttcggcggcgttgctaccattaaggataccaagaagaagcgtgaagtcatcgttacagatccggaatccggagatacaaagacttacctgattccttatggatcacgtattaagatcatggatggtgccgtacttgaagccggtgatgaactgaccgaaggttctgtaaatccacatgatatcttaaaaatcaaaggtgtgcgtgccgtacaggattatatgcttcgtgaagtacagcgtgtatatcgtctgcagggtgtagaaatcaacgataagcatattgaggttatcgttcgacagatgttacagaagatccgcgtagaagagaatggagattccgatcttcttccgggcagcatggtagattctcttgatttccttgaactgaacgaaaagcttgaggaagaaggcaaggaacaggcagttggttcccaggtattacttggtatcacaaaagcatcccttgcaacaaattcattcctgtcagctgcatccttccaggagaccacgaaggttcttacggaagcagcaatcaagggcaagattgatccgttgatcggtatgaaagagaacgttatcatcggtaagctgattccggcaggtaccggtatgaagagataccgcaatatcaaactggacagtgatgtgaacgaagaagaagagttctcatttgacgatctggaagatttcactatggatgaagaagaggaaatgatcccgacagtaaccgttccggatggaacagatctgtcagccgtttccggaactgatgaggattcatcggaagaataaattacagcacagataatagaatctgtgaagatacaaaaggggctgtaaaaaaactcccctgacagaaaaatcgcccagaccgtgaggtctgagcgattttttggtataattaattatgctactaaataacaataccaatggtaattatactatgcgtcagctgaaattaccattagaaatcgaaaaattgatcgatatttccgatccggtatacactttttgtgaggttatggatcacattgacctatccagatattttgtagagaaaggctataaaacaggtcgcccaagatgtgatgctcaaaaactccttaaagtaatactttttgcctttatggaaaatggcatctgctccttacgagaaatagaaaagctctgccgtaatgacattcgttacatgtatcttcttgatggcatgaaaacgccttcttttgctacatttggaaacttaatccgaaacgaactaaccgattctatcgagcagatatttgaagacattaattcatatatttttgccaaagatcacgtggatctgcagcatacatacattgacgggacaaaaattgaggcaaatgccaatcgatatacctgggtatggaaaaaatcgtgtgtgaaaaaccggcagaaagtctttgacaagatttcactcttgattgatgctatgaatcgggaagtacttggatatctcggaataaaatttgaaaagcgtgaagcgtacgcggttgactatgtctctgaattacttacgatgtacaaagaaacaaccggactggatgaaacttctttcgtttccggacgtggtcatagaaaaagcattcgacaaaaacaatacgaagaattgcatgaatatctggaacgtttgaaatcctatgcatatcatatcgagacctgtggagaagaaagaaacagttattccaaaacagatcatgatgcaactttcatgcgtttaaagcgtgattacatgggaaacgatcagctacttccggcatacaacctacaggcagccatctgtgatgaatacatagctgtaatcgacgtaaaaccatatgcatccgatatggaatgctttgttcctttgatggaaaaattcaatcgcacatatggtcactatccgaaatatccggttgctgatgccggatacggttcttacaataattatctttattgtgaagaacacggcatggaaaaatacatgaaatttaccatgtacaaaaaagaaacgacggacaaaaagtatcatgagaatccgtatcgtgctgtaaactttgcaaaagatgcagatggaaatctcttatgtccaaacggtcgaaaattcctcttcaagagaacacagcatgtgaaatataataaatatggaagaacggaagaattatacgaatgtgaatcttgtgaagggtgtcagcataaacaggaatgttgtccgagaacacacaaaaaccgaacgatccgaatgaatcaggaattaactgctatccatcaggaagtgctgcaaaatcttgaatccatacatggtgctctcttgagaatgaaccgaagtattcaatcggagggaacttttggtgtattaaagtgggataaagcgtataaaagattattgcgaagaggcgagaaaaatgtaattctcgagcttacactgatttcatgtggattcaatctttataaatatcacaacaaaaagcaacgacagacgaaagttgcataaaacttaagcgggcgtgattagccgagctttattaaatgcaccattttttatacccaaagatgcagacttgcttagaaatagaaaagttaatacaaagaaacgccaaaaccgacatttgccggaattggcgtttcttatattagggacttattttacagcccctttttcatgtatttcatgtattttttaaaagtgggttgacaagcacaacagaaatttatataatattttagcgtgcattgtggtatgatgcatgcttgaagaataatacaggaggtgaaaataatgccaacatttaaccagttagtaagaaaaggacgtcagactactgtaaagaagtctacagcacctgcacttcagagaagctttaactctctgcagaagaagccaatcaatacttcttctccacagaagagaggtgtttgtactgctgttaagacagcaactcctaagaagcctaactcagctcttcgtaagatcgccagagttcgtctttccaacggaatcgaagtaacatcttatatcccaggtgaaggacacaacttacaggagcatagtgttgttctgatccgtggtggtcgtgttaaggatttacctggtacacgttaccatatcatccgtggtacattagataccgctggtgttgcgaacagaaagcaggcccgttctaagtacggcgctaagaaaccaaaggcagctaaataataaacagattatttggcagacaatgggtcacaaacagagctaaataggtttagtgttgggattattgttgtatccgctaccggatataacctactcattatatagcccgcacgaacacattagagagacacatgtgagtaccgttgaattaattaaaaatgattaaggagggaagtaacgtgccacgtaaaggacatactcagaaaagagacgtattagcagatccgttatacaacaacaaagtggttaccaagcttatcaacaacattatgttagatggtaagaaaggtgttgcacagaagatcgtatacggcgcttttactaaagtagaagagaagacaggaaagccagcaatcgaggtattcgaggaggctatgaacaacgttatgccagctcttgaagttaaggcaagacgtatcggtggagctacctatcaggtacctatcgaggttcgcccagatcgtcgtcaggcattagctcttcgttggttaacaactttctcacgtgctagaggtgagaagactcaggaagagagactggcaaacgagatcatggatgctgcaaacaatactggtgcagcagttaagagaaaagaagatatgcacaagatggcagaggcaaacaaggccttcgcacattacagattctaattggaaatctaataggaggaaaaaaccttggctggaagagaatatccacttgagagaaccagaaatatcggaattatggctcatatcgatgctggtaagacaacattaacagagcgtattctgtattatactggtgttaactataaaatcggtgatactcatgaaggtactgctaccatggactggatggagcaggagcaggaaagaggtatcacaattacttcagccgctacaacatgtcactggacagaagaagagttcacaaagccgaaaaagggcgctcttgagcatcgtatcaacatcatcgatactcctggacacgtagactttacagtagaggttgagcgttcactccgtgtattggacggcgccgttggtgtcttctgtgcaaagggtggtgttgagcctcagtcagagaatgtatggcgtcaggctgatacctacaatgtacctcgtatggcattcatcaataagatggatatcttaggtgcaaacttttacggcgctgtagatcagatccgtgagagattaggaaagaacgcaatcgttcttcagttaccaatcggtaaagaagatgatttcaagggaatcattgatctgttcgagatgaaagcatatatctacaacgatgagaagggtgataacatcactgttacagatgatcttggagatatggctgatcaggcagcagagtatcgtacagaactcattgagaagatctgtgagttagatgacgatttaatgatgcagtaccttgagggcgaagagccatccgttgatgatatgaagaaggttcttcgtaaaggaacatgtgagtgtacggcagtgcctgtttgctgtggttctgcatacagaaacaagggtgttcagaagttactggatgctattatcgaatatatgccagctccaacagacatccctgcaatcaagggtgttgacctggatggcaacgagatcgagagacattcatctgatgatgagcctttcgcagctcttgcattcaagattatggcagatccattcgtaggaaaacttgcttacttccgtgtttattccggaacatgtaagtctggttcttacgtgttaaatgcaacaaaggataagaaggaacgtgttggacgtattcttcagatgcatgcaaacaagagacaggagttagacattgtttactctggtgatatcgcagcagcagttggatttaagttcactactaccggtgataccatctgtgatgagcagcatccggttatccttgagtctatggaattcccagagccagttatcgagctcgcaattgagcctaaaacaaaagctggacagggcaagttaggtgaagcattagcaaaacttgctgaagaagatcctacattccgtgcacatacagatcaggaaactggtcagacaatcattgccggaatgggtgagttacatctggagatcatcgttgaccgtctgctccgtgagttcaaggtagaagcaaacgtaggtgctcctcaggtagcatacaaagagacatttacaaaggctgttgatcaggaatacaagtacgctaagcagtccggtggtcgtggacagtacggacattgtaaggtacgtttcgagccgatggatgccaatggagaagaactgttcaagttcgattccgaggttgtcggtggtgctattccgaaggaatacatcccagcaatcggtgaaggtattgaggaagctacaaaggctggttcccttggcggattccctgttgtaggtatccatgctaccgtatatgacggatcttaccatgaagtcgattcttccgagatggcattccatattgccggatctatgtgtttcaaggaagctatggctaaggcagccccagtattacttgagcctatcatgaaagttgagattactatgccggaagagtacatgggagatgttatcggtgacgttaactcccgtcgtggacgtatcgaaggtatggatgatctgggcggcggtaagattgtacacgcttatgtaccacttgctgagatgttcggatactcaacagacttacgttctaagacacagggtcgtggtaactactctatgttcttcgagaagtatgagccagttccaaagaacgtacaggagaagcttctgtctaataaggcaaaataatagaaaaagcttgaaatatagctgattattcgctataatcgagttagtcggtttgacaacctaaaaccataaaaacaagcccaaaaccgggcataaaatgaaggaggacatttcaaaatggcaaaggctaaatttgaaagaacaaaaccacattgtaatattggtaccatcggtcacgtagatcatggtaaaacaactttaacagcagctattacaaaggtattagcagctcgtgttgctggtaacgaagcaacagatttcgagaacattgataaggctccagaagagagagagcgtggtatcacaatttctacagctcacgttgagtatgagacagagaagagacattacgcacacgttgactgtcctggacatgctgactacgtaaagaacatgatcactggtgcagctcagatggatggtgctatcctcgttgttgctgctactgatggtgttatggctcagacaaaggagcacatcctcctttctcgtcaggtaggtgtaccttacatcatcgttttcttaaacaagtgcgatatggtagacgatccagaacttatcgagttagtagagatggaagttaccgagcagcttgaagagtatggtttcaatgattgcccaatcatcaagggttctgctttaaaggctcttgaagatcctaacggagagtggggagacaagatcatggagcttatggatactgttgattcttatatcccagatccagagcgtgatacagataagccattccttatgccagtagaggacgtattcacaattacaggtcgtggtactgttgcaactggtagagtagagcgtggtacattacatctgaacgacgaacttgaaatccttggtgttaaggaagatgttcttaagacagttgtaactggtattgagatgttccgtaagcagttagacgaggctatggctggtgataacatcggtgcattacttcgtggtgtaaaccgtgaccagatcgttcgtggacaggttcttgctaagccaggtactgtaacttgccatcacaagttcacagctcaggtttacgttttaacaaaggatgaaggtggacgtcatactccattcttcaacaactatcgtccacagttctacttcagaacaactgacgtaacaggtgtttgcgagcttccagcaggaacagagatgtgcatgcctggtgataatgtagagatgacaatcgagctgattcatccagtagctatggagcagggtcttacattcgctatccgtgagggtggtagaacagttggttctggccgtgttgctacagttatcgagtaattaaatattattcagtaaattcaagggtttcggagatttctccggaaccctttttacatgcgataataatgaagatgggtgtgagcggtgccaaaacggtgccaaaaagaaaaactccgttgaattttgctattcaacggagcttttttcttaccatcccttaatctgttttacctgttctgctcgttcgggatctctatgatactgcagcttaaattgtatcgtttcgaccacttctttccttgcttcatcatccaactgataaaaggaagtcagaagattatccacatccggcatactatttttaccgaataggtacataagtggatagagagagtttttcaagtaggttttgactctgcttgcatccaaggctccattcaatccatctgggagagtgggatatatttcttcttcggtaatagctccagagaaaggacttgcagagcatatctcattcacatcaatatctaaagcattggcaagtcggagagcaaagtcaaagcggatattggaatctttttgaataatcgtgtataacgtggtggcactaatgccggtttcttttgcaattctgcgtacatttgtacctttttcatcaaggtactcttttaatttctttccatcgcccataagcaacctcctattttcatagacaaagtaattacgaaaaacataaactcaattatcatcatatcacatttacgaaaaacataaaagtgaaaattacataattttagaattacgaaaaccgtaaaatattatttacgaagtattgacattatttacggacagtgataatatgaatttacgaaaaccgtacacaacaaaaatacaagagttgtaacggcattgtagaatgagaagggaggatgaatatatggcgaactatcaatatatgatgagtgcggatgatgtggctaaggaactggattgttccaagtcgtatgcttacaagttggttaaggcaatgaataaggaacttgcggagcagggatatatcacaatggcaggacggattccaagagcatattgggcaaaaaagatgttcggatacgagctggctgcgaactaagagaggagaagaaaggaatggcttacaaagaaaaagacacgaagaaatggactgcccagtggtttgaaacgaatgcaaagggcgaaaagaaaaaacgaagaaagagaggattttccacaaaaaaggaagctctggaatatgagcgacagaaaaaactcaatagcagtcgaagtatggatatgaaattgagtgaatttatggaggtatattttgaggacaaacagaatgaactcaaagaacgtaccatgaaaaacaaacgttatatgatggaacagcatattattccgtattttggaaataaaatgatgagtgaaatatcagcttcgcagattattcagtggcagaatgaaatgcagacaaaaggtttttcggaatcatatctgcgaatgatacaaaatcagctaaccagtttgtttactcatgcttcacgaatttacgatttgcatacgaatccatgcaagaaggtaaagcggatgggaaactcggacagcagaagcttggatttctggacaacagaggagtatcagcagtttattcagactatagaaccgggaacaagatattatctcatctttgaaattcttttctggactggatgtagaattggagaactacttgcattaactccggcagatataaactttgaaagaaatcaaatcagcatcacaaaaacgtactataggacagaacgaaaggatgtgattacagaaccaaagacaaaacaatctgtgcgaacaatagaaataccggaatttttgaagcaggaaataaagcaatttattgaagggcattatggtatgccggagaatgaaagacttttccctatcgtgcaggaagcggtacagcataagatgaagcacaatatggaaaaagccggagtaaagaaaatcagggtgcatgatttaaggcattcgcatgtagcatatctcatcaacaaagggattgagccgattctgataaaggaaagattagggcataaggatataagaattaccctaaatacttatggtcacttatatccgaatcagcaacggagaattgcagatttgctggataatgaacaagaaaaaagtcccaacagcggcaactgtcaggactaaagataaccggataaacctctgttatcctatgtatatacaagctaagtatagcagaggttttctccggtagcaattataaaattaaaattggaggagaaaatgacagaacagaagattgagttaaagatgattagaatgtcggaggtacagtcgcaggagattgagtggctgtggtatccgttcattccttatggaaagctgacaattatccaaggtgatccgggggatggaaagacaacaatggtgttgaatctggcagcaaagctgtcaaagggcgaagcactggataaaaatatgaaggtcacagagccggtcaatgtaatataccagactgcggaggatggtcttgcggatacagtaaaaccaagattagagcttgccggggcagactgcgagagaattatcgtcattgatgaaagtgacaagtcactgtctatggtagatgaacgcttggaagaagcgattgtaaggactggtgcaaggctcttgattttagacccgatacaagcctatctgggcggtggcatggatatgaaccgagcaaacgaagcaagggatatgacaaagaaattaggagcattggcagagaaaacaaagtgtgcaattatccttatcggtcatatgaataaggcttccggcaataaagcggcataccggggcatgggttccatagattttttcgcagtggcaagaagtgtattactggttggcagggtagagggagaaccgaataccagagcagttgttcagattaaaaacaaccttgcggcatttggacatccaaaagcatttgccttatcagaggaaggctttcagtggattggagattatgagattacggtggatgaggtgcttggcggcattgcaccaaaggcaaataaaatggagcaggcaaagcagatgttacgggaacttgcggaaacacagaatgcggttttgagcaacgaaatctttgaccgggcagatgaactgggaatttctaaacgaacactggaaaacgcaaagaaagagctgggtatccgggcaagaaaaatcaacaacgcatggtactgggaactggataaagtaaagctggaataagggaagaacgcaacaatgcagagtatacagaaatgcggtcttgaacattgcaaggttgcaaaatatatagacattgcgttgttgcggtcttgcagaaaggattggtggattgaaatgaagaatgtgcagatttcgcaggaattgttctttttgctcgtgagatattttctcatagggcaggaagaaacggagccggagatagctaaggcattagagaaaaagatggatgctctggtaatgagagagctgtatacgcagtataaaactgcaccgacagaggaagaaaaggaaaaggcacgcagggaatatctggacaggcgaggtgtgccggacagcttccgatggtaatttccttagacgaataaaacgggagcgtggcacgcacccgtaggatacggttaagggaaaatggtgcggtggcagcgatgatgaagtgaccggaacgggcacaactgccgcaggcataaaagctcccggcagggcgcaaaacctgacttgtcaggttgcatttttgatggcggtagctgtcaaaagtgcttttgcgttactttcgacgaaagtaacaaagcctgtgccgtatccggcactaaaagatacaggtaaaaaaagatgcgaggtggtttttattggagagaacgattagcggaatgatggggaaaggctctgtgaatcacaatacaagagcattttcagcaaagaatgtagataaagaaagaagccgtgacaatgtggaattttgccacaaggatataaaggcagtgtatcatgaactgtttgacgaagctctggaaaggtacaatgcgaagcagaagcggagtgacagaaagattgataactattatgagaaaatccggcaggggaagcaggagaaactgttttatgaagtgattttccagataggaaacagagatgacatgaatgcacggagtgaggaggggcagctggcaaagcagatacttattgacttcatggcagactttcaaagcaggaatccgaatcttcatgtattctcggcacatctgcacatggatgaggaaacaccgcacattcatattgattttgttccggttattaccgggagtaagcgaggacttgataccagagtgtcactgaaaggggcattggcggagcagggatttgagggcggtaccagaggagcaacagaatggaaccagtggatagaatccgagaaaaaggaactggcggcggtcatggaacgatatggtgttgaatggctgcagaagggtacgcacaataaacatctgtcggtgctggattatgagaagcaggagcgagcgaaagaggttgcggagcttgatagtcagcttgcacaatcagaacaggctttgcagacagcaagtaaaatggtagacagtcagcttgctcgtgcggaagaattggcagagatgggagatatgtttcaaagacggaacgaggaaattaaggcagataatgcagaactggaagaagcatatatagccacgaagcagagctataacagtttatctgcaaaaaataatctcctgattaccgagaatgaggatttggagcaggaaaaggaaaggcggttgtccggcaaccgggaattagaaaagcaacagcagaagcttcaaaaagaactggaagctatggcaggttctaaggtcgctctggagcgtaatgtgagagtctatgacgaggaaaaacaatggcagcttccagagccgggagtggtacagtcggcaaaagcctatcgtgaaaaggtggcattgccattgattacaaggttaaaggaacttgtaaaaagtctgacaatcaagtgtgtcggtctgatggagcaggttaagaagctgactgcaaaggtaaatcagcaggaagatgatattgcatggtacaagaataaaatcaaggagcagaaaggaacaatggagcatttgcaggagaaagcggaggatttggaacgagtgaaacagtatgtcggggctgacaaaatacaggatattattgacaatgtgaaagaagcggaacggttacaggcagagcagaagcgtttgcagagaagctatcagaacagaatgagcagataaggagatagatggatatgacggataaaatcaaagaaacagaagtgttgagaaagcacatcattggagaaaacggaatcagttacactttgggagaggatggtctgtattatccagacatccgacttccggaaggaacgcattatgaaatcggcagatacggacagatgcgagcagagtatctgaaagagtaccatagagcattgtatctggaattgctgttggatggaaatttaaatgaatatctgcaccagacggacgaagaatgttatcagatgatggagcgattggtggaacagatgaaagcaaagcagggagtgacggagcagttgaagtcggagaatcaaatgcagtgggtaggaatgatgaacaatatctggcactgtgcggaataagtggtgttgagagatatagtatatgtgtaatagatagggcggtcttcggactgcccttttgaaaattgtatagaaaaaggaacaatgaaatgatataataaaaaaaagagaattagaacaatcgaagtttaatgagctgggaaatcggaatttataggaggtgaatcttcatgaaatgtccatattgtggtgatgaaatgataagaggatacctaatgagttcacgagacattacttttgcagttgataatccgacaaaagtttttttcgtattaaaaaatcggacgatctggaattgagtaaaggttcagcaggaatccctcattgtgaagcttatcgttgcagtagttgcaaaaagattttgattgattatgcaaatagataaatcgaaagttgacaaaggagttgagctgatatgaaaaagaaaatcatcatattgctgtctgttgtgataattcttttgatgggcattgttgtatggtttaatattccactcgacttgatggacttagaccctaatgaggtcatggaaatagttgttttcaatggcaatagcggaaacgcaacacatattaccgacaaagagcagattcagcatattgtcgaaaatttgaatggcgtcgaagtaaagcggtcaaagccatctttgggatatatgggatatagtttcaaagttactatttatttgtctgatggcaacgaggcaggcgattggaataattttattatcaattcagatgatacaattagaaaagatccatttttctattctgttacaaagggaaatattgattacagctatattgaaagtatcgtagaataacaaaaatgccagtttgttaaggtgaaaaaagtttaagtaaaattagaagttataagaagtggaaaaggagaacaagttaatgataaaaaaaatagccattgtaccctatgtaactaatgggagaaattcacaggttggacatgatggacattttaatatttttaaaaaaaagagaagtactgtattaaaagaatatttacagtctgcaattaaagcaaaaaattgggaagcggaagtaattgttgatgtcaatcacggagatttacaatcgctgaaacgagaaggagtaaacttgtttttaattccagaagatattgctaggtatatagactacagcagtgttagtaaggatgagtgtttcaaattaacacatgatgaatatgaaagcggaaatatagatagagtagtgaaatacatagaagaaaattgaaacataatctcttagaggagcttatcaaacttagaatttgaaaggagacataactatgaaagaatatcaacatctaataggtaaaattattattgcgattgcaattatagttgccgcaatcattatagcggtggtcctatgtcaagatttagtacaagttaaaatgagaaatttccccccattttaacctgccagaagctcagcctcagtgttcgttctttcatacacttgttcgaattcgtttggcgacatatagttgcaatggctatgaattcgtttcgtattgtagaaagcttccagatattcaaaaatcaactggtatgcttgcttataatcacggattttaaagcgattgagccattcacgtttgataacagaatgaaaggattcaatgcatgcattatcccacggaaaagctttcttcgagtagctacgctgcatattttcggttgcttttttatattcctttgcaacatattggctgccacgatccgaatggataattaatggttgatcaatatttcggcgagctttggctttgtttatagtatcaatcacgcaggatacttccagtgtttctgaaagtgtccaggctatgatttttctggaaaataaatccataatactggtcagatagacaaatccgtctattgtccagatgtaggtgatatccgaacaccagacagcattcgggcggtcaggattaaactgttcatcaaggatattttgtaattctgtgctgaaatcagaatcttttgtggtgatggtccatggtttgctccactgagcacggattcccatttggcgcatatatgtaccaacggttctttccgaaatgacttcaccggtttttcgcagttctacagtgattttcggagcgccgtagttctgcttggaatcatcataaatatcctgtatttttgcttttacagcttcacgacgtttttctgtatcagaaggtacgtggtggagccatgcaagatatcctgagcgagagacacctaaaaatttcaacattccggagacggaaacctggcgtccagcctttttggcagcttctgtcttctcagtcacttcgagataaatggcttccgtcattttcccagaatgttgattgctttttttaacacatcaagtgcatcttttgcatcacgtaattcacgtctgagacgggcaatttccttctgctcatcagatgcataattaccagaaccacgaacaggaatatcacctgattctcggaagtctttcagccactttgttaatgtactgtagccgatgccaagattttctgcacatccacgtactccgagatctttatgatcttgatagtactggattgcatcaagtttaaattgtttgtcatgttgctttgccatatgagatcctccttcagcatgtttctattgtaccatgcttatgtgtatttggaatttctcattttggcttgtactatttatattctagcaccacgggtgctatcgagggtgcaggagcaaatatccaaagtggtctgtggaagttaagagatgcactacgataattcaagtttgtattagtaaaggaagatgaagtacctacggtgccaaaacggtgccaagaacttaggcaaataaaaatacagtatgcaaaaacagcagttttctgcagattttgccacctaaaagcatagaaaatatgcagaaatacggtattcaaataacgtgagggtggacgtactgtaggatcaggacgtgttgctacaatcatcgagtaattataaattgcttaaaattaagggttcccattattgggagcccttttttggtaccattgcagctctttcatgatagcatccggcattgttatggttcttatgccgttggttgtctttttgtggggacagaatgccactttttggaaagagttatgcggatatgttatggtattggacgtaaaattgatattagaaggtgtgagcgcgagcaattcaccaaactacataccggaataaaacagaagctgcagagcagtgtgtgcagttggattatctaccagggcaatgaagtggttgtactgatcgagcgtctagaagaagaaaagacaatagtaacgacatttagaaattatgcagaggtaaagaaagcatgaatggaagattacaccgtggctcgtgtgacaaccgggatcaatacggagaaaacggacattttaatttctgtaggaaactttggctttgcataagttggatctattcttcggatatatcatagtcagtggctgtatcagaaaattttgtatcccaaatggcttcttcaatggtttgtaaacattcatctgtatgtttggaaatgtcttgtccccagaagtgaaggacagtatagcctagaaatagaagctttttatcattttcataatcacgattacggtttcgttcgatttttttgatccaaaagtctggatttttcccattttcaagtcggagtttgagaatctcccaatcctttccgtgaaaaaattcactatcgcaaaaaatagcaattttatatttggtaagaacaatgtcaggagaaccagggagagccttataatttttacgatagcgataacctttgtgccatagagcttttcggagcaatagctctatggaagtatctttactgtggatcttacgcatattgtttgaaacagtagcggaatcacgtgacatataggtaccttctttctgcctgaactgctgagaatatattatcaaaaaacaggataaatagcaaacgggttaagaaacatgcaagaggaaatctaacgatatggtgagaaaattgcttgttgctaattgtggtatatgataaaatatgagttgtactatttttgattttggaggaattttaatggcgatttgttatgacaaattatggaaattactgatagataaaaaaatgaaccgcacagaattgaaggaagcgtcaggaataagttttaatgtgttagctcgattaggaaagaatgagccagtttcatttgaatcaatagaaaaaatatgttttacattaaattgcaagatagaagatgttgtagagatacaaaaagacgaaccaatacaaatcgatagtgatgcatttacaaccatagaactgtttgctggagctggcggtttggctttagggatagaaaaagctggatttgaaccattgggactaatagagtttgataaagatgctgcagaatctttgaaaaccaataggccgaactggagagttattcatgatgatatagctaatatatcttgtttagatttggaagattattttggcataaaaaaaggagacctggatttattatcgggaggggcaccgtgtcaggctttttcctatgctggaaaaagattaggacttgaagatgcgagaggaacacttttttatcactatgcaacttttttacagaaattacagccaaagatgtttttatttgaaaatgtgcgaggattgctgactcatgataagggaagaacatatgcaacgataacaaatatttttgaacaggcgggatataccattcagaaaaaggttttaaatgcgtgggattttggtgtgccgcagaaaagagagagactaattactgttggaattaggaatgatttagtgggaaaagtttcattctcatttcctaaagaacatgattataagcctgttttgagagatgttttattggattgcccagaaggaccaggagtgccatacggggaaaataaaagaaaaatatttgaattagttccacctggaggatattggagagatatcgatccagagattgcaaaagcatatatgaaaagttgttgggatatggaaggcggaagaacagggattcttaggagaatgagtctggatgaaccatcattgacagtattgacttcaccgtctcagaagcaaacagaaagatgtcatccattggaagcaagaccgtttacggtacgtgagaatgcaagatgtcaaacatttccagatgaatggcaattttgtggaagtgttcaatctcagtataaacaggttggaaatgcggttcctgtcaacttagcatatgaaattgggttggagatacataaatcattagaggggataaaataaatggcgtggaatttagattttatatcagaagaagattttaagaagcatgtgcgtgcaacgattatgaaatatggagaaaaactggaatcgtatgatttgaagcggttcaatagtaacctgattgatccgatcaagctgatttttgataaatcggtgtatcgtacaagctgggaagaaattgtaaataatgaaattttccggcagagagataagtctaataataatgatataggatattttcatcaaaatattttttcttatttcaaaggctgcgaagttccacaggcaggctgggatgttatttacagaaatccagatggaatacaaatgccagatggagatattgtacatacaatatatgtagaaatgaagaacaaacacaatactatgaattctgcatcttctgcaaaaacatatataaagatgcagggacagattttggaagatgatgattgtgcgtgtctgttggttgaagcaattgcaaagaaatcacagaatataaaatggtcaacaaaagttgatgggaaaaatgtacagcataggttgattcgccgtgtgagcatggatcagttttatgcaattctcactggtgaagaagatgcattttataagatgtgtatggcattgccggaggtaatcaattctgttgtaaatgaagaaggcggtgttgaagtaccacacgatacggttattgatgaattgagaaaagtggcatcattgtatggtgatgaaaacggcgagctgtctatggcaatggctgtatatatgcttggattcaatacgtatatgggatttggtgacaaaattcgtggagaattaggagaagataaagacggaatgctgaaacggatttatgaatatgtgaaacggttaaaataggcatataaagaatggtggggaatgaacatgagcacttcgacacatgatttatttgatttttttaaaaaggcaaatagtaatatttcggatgaatacacaagaatttgtagaaaaaagtcgcggaagaaggaacaccggaggagttaatgagcaccaacggaatctaccggcatatgacaaatcttcagatgcagagcgccggatggaaaatacaataagaatcaatggaagcttttcggaatagaggctgcgatattgccgtctacaggtcgggcaaacgcagcctggtcatccgatggactttgttggaattattttttcttttttacaatcccgattccgatcagtaaagcactgatgagaattccggcgacaagaaggaggacatacacgttggcatttacgttgagatctgtcgtccaggtggaaaaattcgcatggcggatggtaagctgtctggtatcatacagaagataactgcaaacatcattggagaaggtaatccatatactgcaaagaagtgtacacagaccgcctttgataaaaccattgaccggaagatagcgaattatgaggaaaaagagccatacaccgatcatcagaactgttgccacaatgcatccggttttcagactgcctaatccggaacggtaagatacggtaaacatggtcaggtagagccaaagcgtatcccagatcatgataataagggcttttttatcggataatacaggcggtaatgtcatttcgcgtatcaccagagggaaaaatacaacggaaagtccgaatacagtcggaacggaccagaagaaaaattctcctccgccattcatggcatttacaaaaaataaaatcagcagcagggcaccgacaccacataaaatacatttcatcagccgtttctgggaagaaataagtggaacaacagtgagtgctgcgacaagcatcatggaagcggttacgacagagaatacgccgagtccgctgccgccggccatggatacaataaaggtaataaggatcggaacaagcagcagggcggcaatgactataccggctttgtatgccaggttccgttcttttttggcatgccgttccagaatttcgcgggattcggtttcaattacgttgtcaatggtatgattggctaaatcttcgtaaattttttcgcagtcagcgcagtcagcaagatgctgtctgaccagttcacagctggcaggactgcatgcatggtcgtaatataatggcaggagatcctgcacaatgtcacattcgtttggattatgattcatggtggtccatcctttctttaatttttaatcttgccctgtgataagtaactctcgcccagttttctgttttcccgaagattattccgatttgtgaaaaggataattctccgaaaactcttagctgaaagacttctttataaggttcctgaagttcatgaagtacgagatgaatctgcagcgcagagtcctgatccgcaatatggtttgcaatatcatcggatgtttccgcagcagatgcatcgaaacaggcatatttttgatttttgcggcattcatcaactgcaaggtttttggctatgctgcacagccatgtgaattcacgggatttcccttcatagccgtgtcgggcagtcagcgctttataaaacgtattttgtgtgatttcttccgccagggactgatttttgacgattgtcatcacgtaagagtaaacctgcaggtaataggaattgtacaatttttcataattcagaaccggtcacctcctttttacacagattagacggcgaaaagatggtttcgttacaaacttttccaaattattttataatatttttcatggatttaacaggaaagaatttcaagtgtctatgttttaaggttaagttaaggaaaacatcataagaaaataatatgacaatttatggcatacattatttccggtgtgaaaaagaaatcaaaagttgtcattggtgttgtatgctctaaaagacttcttaatcaagcggttaggaagtctcttagaacacataacctaaaaccgaagaaaggagcgcaagttatgagaaaaaacgagaaaatcacagctctgtacgaacgactgagccgtgatgactttggcaaagatgatgaccaacagcgtgagagcaactccatatccaatcaaaaggcaatgttggaggagttcgccgcacggcagggctttacaaacattgtccatttcacggacgatggcattagcggcacctgctttgaccgtcccggatttttggcaatgatgaaagaagtggaagccgggaatgtggaatatctgtgtatcaaggacatgagccgcatgggtcgtgactatctgaaagtaggtcagattatggaaatcctgcgtcagcgtggcgttcgccttatcgccatcaatgacggcgtggacagtgccagaggtgacgatgattttacccctttccgcaacattatgaacgagtattacgccagagacaccagccgtaaaatccgttccactttccagtccaaaggcaagtccggcaagcacctcacaggcacggtcatttacggctatctctggaacgaagccagagaccaatggttggttgaccccgaagccgctgatgtggtcaagcgcatctttgccatgacgattgagggctacggtccgtatcagatcgccagcaagctgaaagaagaaaaaatcctcattccgtccgcttaccttgcccagcacggcgagggtgtgaataaaaacaagactttcaaagatgtgtacggctggggttcttccaccatctgcaacattcttgaaaagcgtgaatatctgggacacaccatcaacttcaagactcgaaagcacttcaaggacaagaaaagccattatgtcccggaggacgaatggacgattttcgagaatacccatgaagctatcattgaccagcagacctttgaccttgtgcagaaaatccgtgggaatgtcagacgctacccggacggctggggcgaagcagctcccctcacaggcttgctttattgtgccgattgcggcggcaagatgtatgtccaccgtaccaacaacggcaagcgtatttctcaatatacctgttcccaatacagcaaagtcccagttggaaagctctgcacgacacagcaccgtatcaatgaagatgtggtactgtcccttgtttccgaaatgctcaaagctattgccgagtatgccaagcatgaccgagccgagtttgtccgtgtggtgcaggaagcgcagtccagccagcaaacggcagaggtcagaaaacagcgcacacgccttgccacagcaaagcagagagtttccgagctggaagtcctgctctgcaaaatctatgaggacaacattttaggcaagctgtccgacagcagatacgccactctggacgctcaatacgaaaaggaacagtccgagcttaccgctgaaatctctgctctggaaaaggctgtcaagagctatgagaagcacgaaaaggacgctgaccgttttatcgctctgattgacaaatatgagaacttcgacaagctgaccattgccatgctcaacgagtttatcgagaaaatccttgtgcatgagcgtgaccgcaagggcagtatacagaccacacaggaggtcgagatttacttcaattttgtcgggcgattcgttcctccggcgtttggagaagtggagcttaccccagaggaattagaagaaatccgcaagcgtgaggaacgcaaagacaggcttcatcagaactacttgaagcggaaagccagcggagcgcagaagcgatacgaggacaaaatcaaggggagaaaaaaggcagaaatcgaagccaagaaagccgccattcgtgcggaggatattgcaaagggcgtgttcgttcccgccagcagtttaccgcagagagagccgatgaaaggagtacaaacagcatgaatagcacttacacacggaacggcgattatcttatcccgaacatcattatccgcaagaccaagcccatcggacactacggcagacttcgcaaggcgtatctggaaatgcaccgcccgatactgttcaatgagctggtgctatctgataggctctttgagcattgcgccgagattgacgaagcggcacgaaaccgcatggagctgatcgtgcggtcactggcagagcaaaacggcgtgaccgaacagctgaaagccgaaaaccaaatggaatgggtgcggcagatgaacgcttgcaaggcacaggcagaggagattgtgaaagcggaattgatttatgattgagcgaggaagtccgggcagaaaactgttcggacttttctcatatagtccaaagttgcggtagaattgttcacaagttttatggtataatttgaatacgaaattgagcaacaaatcggaagctgtggaggaaaagcattatgaaaaaaattatgtttggtaacagtttaatgctcttaggtattgcaataatgattcttgcaggtttagagctgatatacattggtattatgtgggcgtcttttcttttaatacctgtaggatttattatggctgttataggtttttttagcaaagacagttaaattcaagttgaacaaaatcgctgcgcgatggcctgccaaggctgtggcgcagctttctttttctcaataataaaataggcaatggcaattcttaccagtatttgatattgtaaagttaccacacaaaacaattcaatacagaaagacaccactgcctatgaaaagaataccatttgaccgcttttctgacaagcggttttattatgctaatgcacctccatgtaagcagtttttttcattaactactgattttacatggaggattttattatgtacgaagaaatttttaatcagattcgatctgctgcgaataaacggaatctcaaggattccacgattcatgcatactgtaccagtgttgctcattttttgaaccacacagccaaggatatagatgcattaacaactgacgatgttgatatattcctaactgaaaagaaactttccgggatttcaccggaaacatacaatcactaccattcaggaatccgcttcttttacaaaaaaatattgaagaggaattgggatgatgatgacatacctcgtatgaaaagggacaggaagttaccaacggtgcttacaaaaacagaaatatcagctattcttgatgctacgccaaatctgaagcacaaagctatgattgccactatgtattcaggcggacttcgtgtttcagaagtcacacatcttcattatgatgatatttcacgcacgaacaaaaccatacacatccgtgatgggaaaagtcgctctgatcgttatactttgcttgcagaccggacgctcgagatattgacagaatactggtttcaatgtggcagaccaagagggattttgttcccaagttcatggacaggggattatcttacaaaagatagtgtcattcagttttttcgtgaaagtgccaaaagagcaggcattcagaaacacgtctccacgcattgtttacgtcacagctttgcaagtcatctgtttgaatccggctgtgatgtaaaatatattcaagcgcttctgggacatcgtgatccaaaatcaacagaggtttatctgcatgtaagcaataaaactctgcttggaattaggagtccatttgatgagatgggcggtgaatgattatggagaaatcatgtacgatacaagatgtatttgaacggttttatccttcttatgaaaagaggaatagccctcctgctcatcatagaaaaacagcttatcatatcatgaactgtaaaacaggcgcttttggtgtaaacatcagtgtttgtgaggactgcggatgtatcagcattcataataactcctgcagaagcagatgctgtcccatgtgccaggagtttccgaaagagaaatggattgatgcacaaaaagagaacgtacttgatgcaccctattatcatgtagtattcacagttcctgaggaattgaatcctatcatttatagcaatcagaaacttttgtatgatgcactgtatcatgctgcatcatccactctggacgagctggcgaaagattcaaagtatctgggagctgacatcggatatatctgtattcttcatacatggggttctgcaatgaattatcatcctcatatccatacaattgttcttggtggcggacttgataaggacagcaaatggaaagataccggtgggaagttttttctcccatatggggtcattgcaaaagtgttccgtgggaaatatttgtgcgaattaaaaagcctgtggaatgattcaaggtttgagtttcatggtacagcggagaaatatcaaaaccactattgcttcaaaggacttctcgatgagtgctataaaaaagactgggttgcttattgtaaggaaacatttaatggagcacagtcagtcataaattatcttgggaaatatactcacaggatagcaatcagtaatcatcggatcaagtccatgacggaagcaactgttacatatgctgtaaaagactataaaaacaaaggtcagtggaaagagaaaacagttccgggcgaggaattcatccgtcgatttttaatgcatgttccaccaaaacgttttgtcagaatccggcactatggtttgctgtcgtgccgaaacaagagcaaaaagatgacgcactgtagaaatctgcttggatgtaaaaaatatatttctgcattgaaaaatcgaagtgccactgaaatgataaagctgctatataacatagatgtatgcaggtgttcttcctgtggcggaaaaatggttccacatcttccagataagcatacaccatctgttttagcgcatatgagatgttaaaatatacaactgaatacttcaaaaaacttccgcaaagggagtctgtttgtcatgcctaaaaataattcttttggcaaaaaccagctgtcaataaaacacgagatatgataaacttatagaagagagcaaagattgaattcccatagaagttgcgaaagggacgcgactttgttcaccaaggaaaaatcgaaattgatgtaaacgaaagggcagtttgataaaaccgcaagactgctttttcgtttacaccaactccgattgtttccttaacaatttgtcgcactgataaaatccctttaggaactaaagggcgcacttctatactctctgtcgagagtagtgcgtcctgcggagcttcattctccgtcagcagaagaaaactgcatgaccgagaatgttgcgtcacttcgttccgtcaaggtggctacacccccttgcgccgctaaagcggctatcccctgtggacttgccgtccgcaaacggttttgacaaaccgttcgccgccagcaagtttgaaaatcaagaatcttaatttgataaaggagtgtgattctatgaaaaagaaattacccataatcctcttgggtgttattttggcttgtgtgttggttttcggtttcctttatgcaaacaatgacattggtaaaaccgcaaacagtttagaagcagacattcgccaatctcaaaaaattttggatgattggattgttgatggaagcatttccgacacaatggctgcatttatttcttacccacaggacaagacagaccacactttttctgtctatgtaaatcgccctggcttgtcttttggatatttcttccgtggtggtggagatatagttgaggttgatgattacattgcagagtttgttgttgagggaaataacgaaagggcatttatctcaatgaatacccaaaatattgttcgacttgaagtagatgatggcaacggcattcaggtgattgatattgatagtggcaagcctttcgccattgtcctgcccctcaatgtaggaaacatctgtttctatgatacgaatggaaatgttgtggaatatcttcgccaacaactttgaccaacttcaatttaccgaactgaacacaacaactgaataccgaaaaactgaccgttgactggtcgcactatgcgaaaagttgacggtctttttttatccccaaaatcaaaaaaggaggtcaatcccaatgacaaaaccgaaaaccctcgaccagctccgagccgaaaaggaacgagctgagacgcagcttgcacaggaacagcacaagctggagcgtctggagaacagaaagaagtatctggagaaaggcgaacgcaccaagcgcacccatcgtctttgcaatctgggcggcacggttgagagccttgccccggaggtcaaagatctcacacgcaccgaaatgacagagctgatggaacacatcttttccctgtccgaagtccagcgagccgtccgtcacatggcgattacccatatcagccaagcaaacaaagaaaaggagttgaaagccaatggcactatttcatctgagtgtcacgcagactaagcgaagcgcaggacagtccgctatcgcttctgctgcctatcgttccggcgaaaagctgtatagcgagtattacggtgaatacagcgactacaccagaaagggcggcgtgatctgctctgacattctcctgccgtcccatgcaccgccagaatacgcagaccgccagaccctatggaacgccgtggaaaaagccgagcgtggaaagaacgcccagcttgcatacagctttgacattgccttgcagaatgaattttcccttgaggaaaacatcgctcttgcaaggcaatttttgttggagaactttgtgagccggggcatggtggttgacttcgccgtacaccagccagaccgtgaggacggcggcatactcaatccacattttcatgtgctttgccccatccgtcccatcgagcagaacggcaaatggggactaaagcaacgccgggtgtacgaactggacgaggacggcaaccgtatccgagaccagaacggagagtttgttttcaacgccgttcccactaccgactggggcagtcccgaaacgctggaacattggcgtgaagcatgggcggagatgtgcaatgccaagtttgcggaaaaggggcttgacgttcgtatcgaccaccgaagctatgagcgtcagggcgtggagcttcttcccaccgtccacgagggcgcaaccgtccgggcaatggagaagaaaggcatacgcaccgagaaaggcgagttcaaccgctggatcaaggcaaccaatgccgttatccgggacatcaagaagaaaatcgctctcctgtttgattggattgccgaagcaaaagcggagcttgccaagccgcaggcaccaaaccttgtttctctgctgaacgcctattacaccagccgcagagccggggcttattcgcagaaaggcaaggtcagcaacctaaaggagatgaacgaaactttcaattatctccgggcaaacggcatttattcccttgaagatttggaacaccgtgtcagcgaacacagtgctgccacagagagcttgaagaaaacgctggacgaacagaccgcccgaatgaaagcaattaagcagctctatgacagctccgctgctttccagagcttgaagcctgtctatgacggcttgcagaaaatcaagtttgagaagcccagagccaagtacaaggcagagcatgaaacggaactgaaacagttctacgccgccagacgaaagctgaccggggagttcccagacggcaaggtggatatgaaaaagctgtccgacgagtatgacgagctggaacaggcgcacaacaccacctatggcgagtttaagaccgtcagagacgatttacaccgtctttggaaggtcaagtcatgcgtagatactgccgcccgttttaacgagcgtacagaggaacaaaagctccaaaatcgaccccaaacacgacagaaaaaggaggaactatcccgatgaattacacccaagcacagattgaccgggcaaacgccgtcagtctggaagattttctccgcacacagggagagacacttatcaaaagcggacgagaataccgctggaaagaacatgacagcctgaccgtccggggaaacaagtggtttcgacacagccagagcaagggcggctatcccattgattttgtcatggagttttacggcaagtcctttcccgaagctgtccagctcctgaccggcgaaagcggcgaaggacagaccgaagccaccacagcaccgcccacagcgttccacttgcccttgcacaaccgaacagccgacagagcaattcaatatctttgcgaaagccgaggtctcaacaaaacgcttgttgaggcttttcttctttccggggatatttacgaggacgcaaagcggcacaatgttgtgtttgtcggcagagaccgaaacggtacgccgagatacgcccatgtgcgaggaacggcagacccattcagacaggacattgccgggtctgacaagtcctatccgttccgctatgagggaaacggcaaccagctctttgtctttgaagcaccgattgacctgttatcattcatctgcctttatccgcaggattggcagacaagaaattatcttgccctgggcggcgtttcgagcaaagcccttgaccgtttcctttctgaacgcaaggacacccgaaaagtgttcctctgccttgacagcgacaccgcaggaagtgaagcctgcacccggctggcacaggacattcccggcgagatcgccgtcattcgtcttgtcccggcaaggaaagactggaacgatgttctccgtcagcaaggggacattcccagccgcaaattcatagccgagacaatcacgctgcgagagctgcccaccgcccagcctgtcccaatgctccgtatggcagatgtggagcttacgagcgtggattggttatggtttccgtatattccctttggaaagctgaccatcatacagggcaaccccggcgagggcaagacctactttgccatgcgtcttgcggcggcttgcaccaaccgaaagcctttgcccggtatggagacacttgagcctttcaatatcatctaccagaccgcagaggacggtctgggcgataccgtcaagccccggctgatggaagcggaagcagaccttgaaagagtgcttgtcattgacgatagggacacaccgctgacccttgccgatgagcgcatagcaagggcaatccgtgagaacaacgcaaggcttgttattattgacccggtacaggcgtttctgggcgcagatgtggacatgaaccgggcaaatgaagtccgtcccatcttccgcagtttgggagacattgcacaggctactgggtgcgctatcgtgctgattggacacctgaacaaagccgcaggaacgcaaagcacctaccggggattggggtctatcgacattacggcggcagtccgcagtctgctttttatcggcaagctgaaggacagccccacaacgagggtgcttatccatgagaaaagctcccttgcaccgcccggacagtcccttgcattttctctgggagacgagaaaggctttgagtggataggggcttatgacattaccgctgacgagcttcttgccgggacagacaccgcaaagaccgagagcaagaccgcacaggcgcaaatgctcattctggaactgcttgcaaacggaaagcgtatgccgagcgcagagctggaaaaggcagtcaatgagcgtgggatttcctcacgcaccatgagaacggcaaagagccgtatcggggacagacttgtgaccgagaaagacggcacagcatgggtctgctatctccgagactgacaacaggaacacggcaagcgtggcaaagtcggcaaggtttttatagataccttaatgttgccgccttgccttgttccctcataccgacaccgcccgatgatgaaccgtcaccgggcatttttcatttacaggaggattttgaatgaacaataccgcaaccaacaccgccacttgcccgactgtcagaaagcagattggcaagaccacctatatcgtccgtgtccatttcagcgagaccgccaaggagacgatggaggacaaaatcaagcgtctgctccgtgaggaagtccgcaaaatgtaacttctttttgaatttgatgaaaaagtccttgacttttcgtctctggaaaggcaagtataaggattccgttttttgagcgtctggataaactgaatctgcgtctgattccgattgatgtcaagacgagtaacgccgtaccgacagcggattacatcaatatcaatgtggatgccacggtcaatgtcaagatcagtaatgatccggagaaactgcgtctggcagcagagaactttctgaataaaaatacagagtacatagcaagtgtggcacgtgaagtgcttgaaggtaatgtgcgtgagattgttggtaagatgcggctggaggaaatggtttccgaccgtcagaaatttgccaaccttgtcaaagaaaatgcggagccggatctggcagcaatggggtggatcagattgccggaaatgtgccggtggtcatggcaaaagtctttgagagcatgaaagaagcaaccggaattgatctggcagatattatcaatgccgagtcttacgatgcaaaggtcaaccgcaatgtgaatgtatcgggacttgattccgtgaactttgtagtaaaggatgacggaacaaaggttacgatggcaaaagtggagccgcagaatagtacaaaaccggtaagtacagatgtaccggaatccggagaacagggataaaaccaaaagaaagagaacagtgtcagatgataaatcggggcactgttctctttttgtcggtgatgattcatgcgaaatgtttaaataataggtgcaattcggaaaatttttcgttatactaaatatatgaagatgaggaaatgaaaaaattgaaacagcaatcgcagcattacagcaggaagcaacggaagaagaggtaaaaggttcaggaagtgttatgtctatgtttttggcagatatgcatcagctttttacgcggcacttcctgtggatgaaatcataggaataaaggagagaccacgtgggcagaaaaaaagagcaggaacataaaactttagcccgttggatcattgataaaaccaataccgatcattacagggcggggatgctcagtggatggaaacatccgtatattgatgcggatgttatggaaatagtgggtggaagaaaacagcttttggatcaggcaaatattcttgaaaatgagacaaatgcgggaaagatggggaagtttaagcccgattggaaagatgtaaaaacaagtattaagaaaattgattatgatgttgcgattattccggaattgtgtgaaagggaacaaatcgaagatccaagggaaaggcagcttcgtctcattgcccgtgtggaaaaatggcggagaaaaggacaggattgtgcatggttgtgctcctactatgatgatttattggatctgttgaacagaggcaaagagcagaaagaactggaagatgaaaccttttttgtatgtatagatgcagttgcacatcaaaaggaacacgtctggaaacgggtgttcagtgcgcgtgtccttcacaattccaaatgtttccaaaaaaattatgaggatagaatactgtctgttttaaaagaaaaatccccattttatatagaggaaatgagtgatgatgaactgctggatgcgcataatattcattcttatgcgcagacgcttgagtggaaaggcacactgcagtatattataaatgatgaaaaagtaattgattcttcatcacagatttatggaacgattataaatacacagacaatggaacatgcaagggcgtatgccctgtcaggttgcaaaagaatcatgacaattgaaaataaagcaaactatgaggacatgtcttatagaaaagatactctttatatattttgtcatggttttttctctccaaaggaagttcggtttttgaagacgatttgtgatctggtttctgaggaatgtgaattttatcattggggagatctggattatggaggaatctgtattttccagtttattaaggcgcaggtattcccaaaacttcttccatacaaaatgagtcaggaggattttgaattagcagtcagggaggatgcaggtattttattaaaggaagataccagaaataagctgataaggaaaaatgcaggactactggaaccattaaaggaagcaatacttaagtcaggtctgacgatagaacaggaacggctgttgtagaaaataaagaggaaattcattcatgattttaaaaaagaaaattccaaaggaattttataaactatttcgcacgaaaaaccgtgatgcatatatgcagtttcttgtggcaatttatgaggaaaataatgaagtgtatacagcacttggattgacgatagaggaatgccgtgtgattattgcagatacaattgcaaaggcaaggattatctgggaggatgaggaaatagaagaagaggacgagccggataccttatttccggaagattcgccgtctggcatattgaataccctgattcggtggggatggttaaaaagcgattttgatgaaaagttaaatacgtatattatttctttcccggaatacagccagctgtttacggaattgtttcagaagcttcagacagaagatgacagccgggagagggaaagtatcctttcgatttacagtgctttgtttacgtatcattcggacacagaaaaaaataatgatattttaaaaaacgcactccagacgtccagacggctggggcagcttctttccaatatgcaggatggaatgcgttcctattttgaggaattgtcgcagaaaaaaaattttattggaattcagaaagttctggtagaggaaattaacaacagtgacagtaaaaaatatgcaattcttacgacaacagacagcttttaccgttataaggaagcagttaaagaactggtcagccagattcttcgcgaaaatgaccaaaaaagggaacagcttgtaaaagagcgtaccggacttgtggagggaactgttaccagcaaaagaaaccagtatcgtctggaatattgtgaaagtgccagtcagcttgtgtatcaggtggagcgggaatttgatctgatcgaaaaaaaatataacaggctgatcgaacagaaaactgtctttgccaagcgtgcactggcacgaatccattatattctgcaggaaggctcttcggatgaagatcatattgtaaagttaattaatttgttagatcatcatgcaaacagcccacaggtgttagaacaaatgcgtgaccggatcagagtgggaacacagtttaagaatataaccgatagaagtttttacaaccggaaaaatgcggaggatgcaggatttcacccgattgcgatggaaaagcacaacgaggagactcagatgaccgattttgtaccaaagccgctttatacgaaaaaacagttgcaggaattcaggcagaaaaatatcgtggacggcagatttgtcacggatgaacagacgattcagtccgtagaagatctggaaaaactgctgtttttgtggcaggaggaaacggatgatacgaaacaggaggaaacggtgcatattgatggagaattaaaaggagaatatggatttgttttttcaaaactggtgattgacgcaaaaaaaggagagaaaaaataaatgttagaatacatggaaaatatctcgcagagtgaggcggaaaatattagaaaaaccatacaggatctgtttcgccagacctgtattttgcagacaaagtgtgatccggttactctgatccagaaggataatcctcactatcaggtatgtgcgagaaatcgggaatttattgcagattatctgcaggtgcttgactgtgaactggttcatgatccgcaggaacatattttccggattacaggagatggcgtgctgacggagcgtatgacacttttaacaacgaaactggtgatccttatgaaattgatttatcgggataaaattatgggagaaggactacatgccacgacaaccagtcttgcggagatccgaagatatggaaaggaaacaaacttgattacgcgcagactgaccgctcaggagtggcaggaggcattgattctgatgaaaacacaccagatgatcgaactgccaagtgccattggaaatctcgaagacgattccccaatttatatttacagtaccattaatattttctgttcagcggcagatatcaatgagctggttgaaatgttcaaaggagaaaccggggaaacggaagaacaaaaggaagcagagtattcggaaaagacgcaggatcagtgggaaacacaagacgaaatgaggagtgaataaattgagtcaggcaaaaaaagtttttacaaggatgtgccttaacaactggggaggcattgatcataaggtactggagtttcatgaatatgtgaatttgttcagtggaaaaagcggatctggaaaatcgacagtgatggatgccatccaggtcattttgtatggaagtttctcaccgagttttctgaataaagcagcggatgatgcaaaaaatcgcagaagtgtgttaagttatctgcgcggagaacaaaaagacggatctgccaatcgtaaagactgtgatttctgttccgtaattgctctggaaattgaagataccggaacccatattacaacctgtattggaattgcgtttgaagtaagaaaatcagattctgagattaaaaaatttgtgtatttcagtcactccgggaaaatgccagagtctgaatatctgacggaacagggcgtctgctattccaatcaggagatcaaaaagctggtcagtgccagaacaaaatccgatgacaaccgcggaaagggagaagtcaaccgcatttatggttccaaagaggcatatctgggaactctgtatgatgtaattctcgggtatattgatcagaaccgttttatcacgatggaaaaaagtgcaattgccctgaaaatgaccaatggaacgggacagtttattcgtgattatatgtttccaaagaacacttccaataccattgcctcgattagtgaacaattggattcttaccggcagatcaaagataaaatagaagatctgagaaaacgaatcgagatactgacagatattcagacatccgggcaggaacttgtgcgtctgcagtccgataagatccgggcagaggcaatgatccgctgcattggaattgaagatttgcgggcaagaattcagaccgcggaagaggataaaaagatcattgcagagaaacaggagcagctgcagggaaagataaaagaacgttctgctgtgcgtggggaaaccgaacaggaactgattcaggtcagtgcagatcttaagtccagtgatttgggtggaaaacagcagcagtatgaggaactggatgcacgcagccagatgcttgcggataatacgagacagtggaacaagatccttcttggaatgaaaaactgggaagaagatgatgtgatcaccgattatatcagtaatccggttctaaatttgattgcagaacttggcagtggaaacgtaacggaggaattgtgccagaacctgcatttaaaaattgaatctgccaagcagaatatcgaaaatgaagtggaggattacagtgagcagaggcgcgagatcggaaaagaattaaaagaaaaaaagcggctggtggatgacatgaaacataaccgcaaaccatatgaggagaatctgaggtctgcaagaacggcattatcccaacagctgagtgaccgctatggaacgactgtcagggtgcagatttttgctgatctgtttgatgtgcaggaggaagaatggaaaaatgccattgagggacgcatgggaaggctgaaacgttccctgatcacggaaccacaatatgcacatgaggcagcagtcctgtttcgcaacatgaagcaatatgaaaatgtggatttaattaattccaaggcgattgcggacagtgagccggattgtttggaaggatctttatatgatgcagtaaagacagaggatgcttatgtggatgtatgtctgaaacggtatctgggacatattatgaaatgcaggtctgtggaggaactggagcaggtaagggatggtgtgacaccggattgttattcgtacagcaattttattttccggcatcttaagaaaaaagactatacgaccagagcgtgtattggacgccgtgtttccaaggcgcggcttacagaatatgaaaacgatgtggaagatttaagcagacaggagacggaattggatcatctgctgcgcagattaaaagctgcaagagaatttgagtgtctgaaagatgagccatctcattacgtgaaactctccaaggcgggtgctgagcttgcaaaggtaaataaaaccaagaaagaactcgaagaagtgatccgctttttgcgggagggggcatacaaagaactcgaagagaaggaacaggctttaaagaagcaggtgcgggacatccagactgagatcgatgaagtgcagacagagctggcaaagctaaccagccggtatgggcagctttccggagaaaatgagtccagaagacagcagctggaggaaaagctgcagggatatattgccaatgaagaactcgaacaggaagtgtgggaattgttaaaaaagcaatccgggcagtccgtgattaacaggaagaaggcagagattgcagatctggcagataaggagcaggaacaggcagaacgtctgcagatggcgcgaaataaatatattcttgcatatccggccagtgaattcagcggagctgagaaatccaatgaagcatatgaaaaactgcttgaacggtacaggacggattttgagccggcatacgaagaagaatttgaaaaaaagtgtgcatccatctataagagtctccgggagaatgtcattgcaacaattcacggagatatcaaagcagctaaacggcacgcatatgagatcaaccgtctgctgcgggaaaccaatttctcagacagcacgtaccagattaaaattgaaccggccaaaaatgaaaacggacagttctttgatatgcttatggcagaggaactcgacagcaagaatctggacaatgccggaattgacggtcagatcagtttcggagaagatgcattttatcagaaatatgagcagaagatcaaacttctgaccgacaagtttatgccaccaaaagacgaggatgagcatttgcgggcacagaagcgcaaagaaatggaacagtacgcagactacagaaattatctgtcattcagcatgtttgaacaggtaaccgatgaacatggaaatgtgatccgggaaaactttgtcgatgatatggcgggcagggattccggtggtgagggacaaaatccaaagtatgtagcactgcttgctggatttgccatgctgtatatgcagcagagtaagcgggattccaaaattaagctggtactgctggatgaggcgttttccaaaatggatcaggagcggagcgcagtctgtctgaaatatgccagaaagatggatctgcagctgattgtctgtgtgccggatgagcgtttgcagtctctgatccggaatgtggactgtgtatatggattccgtcggtttaaaaaccggatttccatgatgcatattgataaggggcagtatctggaaatgatggaaggataaaattggatagttgattttactacctctgtagtggtatgataattctattgaagattacatgcaaaagaggagcatggttttatgaaaaaaaggttttattgtctgcttgcagcagtacttatggcaggtgcctgtatctgtgtaccggtggcagaagtgaaagcagaagatggttataatattgattcctatgataatgatgattggtatgacagtgatgatagtccaacggatatggttctggatttgtctaatgtaacaattgataaaaccagccagccaaagcgtatgcaggaaaaattttacgactgcagttctctggtgtggaaatcttatcataagaatggtgtaaattttggaatggcatattatgcaccggttgcggcagatatgggaaaatggtgtgcacagcataagaaacttgtcagcggaggtctgagtcaggcaaatatacaaaatatgaaattgaatccgggggatgtgatgtttgaaaccggacagaaaaacggaagatataaggggatctatcatgtggaaatgattaccggttatatattctatggatttgataggaatggaaaggcagaacttggaattcagtgggcaactggagatgaaaaatattacccaatggggcagatggtaggcaggccgtaaaggtctgtctttttttgtcggaatatgttacaatgcaaaaaaatgagaaagagggagaaaaggatgtttcagtcacttgaatataagcacccgaaattttatcaggtattccgcctgtttattgtgttttttgcttcacttttgtatgcgtggaatctgcgctgttttgccaaaacggcaggcctgtttccgggaggattttccggattgtcacttttactgcagcagatcgggttagattttatccatgtcagtataccgttttcggtgtttaacatcggactgaatctggttcctacttacattgcatataaatttatcgggaaaaaatttactctgtattctattattgttattgtactgacgagtatttttacagatatgcttccggcgtatgtgtttacaaaggatgtgctgctgatcagtgtgtttggtggactgatcaatggatttgccatcagtctgtgtttaaatgtcggcaccaccacgggtggcaccgactttatcagcatctttttatcacagcagaagggcattgatgcatggaattatattctggcaggaaatgtgctcatgcttgtagttgcaggtgctttgttcggctggtcgattgcgttgtactcgattatttaccagttctgcagcacacagatcattcaggcactgtacaagcgttaccagaaggaaacgatgtttattatttctgataaatccaatgaaatctatcgtgccatccgggaacggaccaaccatgatgcaacgttattccaggggatcgggtgttatgaggaaaagcaaaagaccctgatttattccgtcattaattccgaggcaaaaagggagctgcttccgcttatccgtcagattgatccccatgcttttatcaatgttgtgcggacagaagaacttgcggggcgttttcatgatattccgcatgattaaaagctttatgcagattcaatctcataagtaaagccggcatcctcgatggttttgatggtatcctggatgccctgtccaccggcggtcagataaccggaggcgaagatggaatcgacgacacttaaaagctttttttcttctcctttgaaatatacctcacggccggcggcacagcggatatctgactgtggaaccatcagtcttgcaaggcagaggactttcatgcagtattctgtggtcagaccggaaatatctttatcgcctaacggagttcccttgatcggaagcagaaaattgatcggcagtgcttccggctggatctcacgcagttccatcagcatatctaccacatcttctttgctctcgcccataccgatgattccgccactgcagatttcaaatccaatcttctgcagcatatgaatattttcaacacgctggtcaaaggtgtgggtggagcagatatggctgtaataggcgcggctgctgtttaagttgtggttgatgcggtcaagaccggcatcgtagagcgtgcgtgcctgtttttccgttaaaaatccaatggaacagcacagatgtgtgccggttttcttcatggcacggatgcgttcggcaagttcttcaatttcctcatctgtaaatttcattccgcttaagccgatacagtggcggcttaaatggtgttcattgacaaaatcgttatccttgtacagtttctcatcggaaacccatttgtatttttcaatatctgcggtggaacggcaggattgtgcacagtatgcgcagtcctgggaacagttgccgctgcgggcattggtcagaatatggatgctgacgtgatttcctttatattttctccggagtttttcagcacgggcgatcagatcatccagctgatcgtccggagtgtttaaaatagaaagagcctcctcacgggagagaaccggatcgttttcttttgttgtatgcatttgctaaataccttccttgtgtgtaattattaacaatatgcattcactttagcatggaaaaaatgaaatgtcaacgatgatgagtgaacgggttgacaataaagagtaaaaaacccggagaatgaaaaaattctccggatttgaagtattataataaaatttttgatttatgctttagtaagcgggatccgtttataataagaagaacccctgcggcgattcctgtggcaagtacacagattccgatcacgaggcttgatacggctgatgatcccattgctttatatattttctcgttcataaaaacaaacctccttaaattgacgaagtttaatatcttaattcattcttattttaacacaacatccgttgacattgcaacgtggatttgctacagttgacagtgtataaattaaattagaaaaataacacgaaaatatatagtaactgagaaaaatcaggaggcatagagatggcaaaaattatattaaccggggatcgcccgacaggaagactgcatgtgggacactatgtaggatctctgcgaagaagagtggaattacagaattcgggagagtttgataagatttttattatgattgcggatgcacaggcgctgaccgacaattttgataatccggagaaggtgcgtcagaatatcattgaggtggcactggattatttgtctgcggggttggatccagcaaaatccacattgtttgtgcagtcacagatatctgaattgacagagcttacttttttctatgccaatctggtaactgtttccaggctgcagcggaatccgactgttaagtcagaaattaaaatgcgcaattttgagaccagtattccggtcggattttttacatatccgatcagtcaggcagcagatattactgcttttaaggcaacggttgtaccagcgggagaagatcagcttccaatgattgagcagacaagggagattgtccgtaaattcaattccatttatgatgaggtgctggtggagccggatgtgctgcttccggagaatgaggcatgtatgcgtctgccgggaattgatggaaaacagaagatgagcaaatccctggggaactgtatttatctttcagatacggaaagtgatgtcaaaaaaaagattatgagtatgtacacggatccgacacatattcagatctctgatccgggacatctggaaggaaactgtgtatttacctatctggatgccttcagcaaaccggagcattttgaagaatatctcccggaatatcataatctggatgaattaaaggaacactataccagaggcggtcttggagatgtaaaaatcaaaaaattcctgaacaacgtcattcaggaagagctggctccgattcgtgcgcgaagggcggaatttgagaaagacattccggcagtatatgaaattctgaaaaaaggaagtgatgcagcgcgtgaagttgcagcacagacactttctgaagtaaaacaggcgatgaaaatcaattattttgatgatgaagaactgattcgtgtacagagtgagaaatatcagggtgtataaaaagaaaggatcggaaaatatgatgatgaaaaagacaggactgctggcagtactgacagcaggagtacttttatttgcagggtgcggtggggaagcaaagacaattgatgcgcaggctcttgcaaaatcgcttgcaacagagattaaatatgatgatacattaaaggaactgacagcggatgaaatttcaatgcttgtagatttaccggaagatgttgattctgttatgtatgccggaagcggttctacggcagaagaggtaggtgtttttaccgcaaaagattcaaatcaggcaaaagaaaccatggaagatgtccagaaatatcttgatgatcaggcggattctttccaggattatgtgccggaagagacaaaacggattggaaatgcggtgctggagcagaaaaatcagtatgtggttctgtgtgtgtccggggattcggatcaggcaaaagaaattatagaaaaggcgtttaaataaaatggtttttagtagttttgtatttttacttgcgtttttaccgatcgtattattgctgtactatctctgcccggcaaggcttagaaaccttgttttattggttttcagtctggtcttttatgcgtggggagagccggtctatgtattaatcatgctgttttcgattgtatttgattatgcgaatgggcggttgatcgagcactttaaaaacaaaaactgtccggggaaagcaaaagccgcactgatcgttgatctgtgcggaaaccttgccatcctcgggttttttaagtacacggattttgttatcgggagtatcaattccattacaggggcagggttgtcgctgctgcatatagcacttccgattggaatttctttttatacctttcagacaatgtcctatacgattgatgtttatcgcggggaggttgcagcacagaaaaacatccttacatttgcgacctatgtaactctgtttccgcagctgatcgcaggaccgattgtgcagtataaaacggtggaaaaagaactcatgcacagaaaagtcacgctggaagatttttccgaaggagcatttcgtttttccgtgggtctggcaaagaaagtgcttctggcaaatcagatcggaagtctgtgggattccatttcacagttgaatcacatgtcggtggctacggcatggcttggtgcaattgcatacagttttcagatttattttgatttttcgggatattcggatatggcgatcggactgggcagaatgtttggattctatttcctggaaaactttaatttcccgtacatgtcaaagacaattacggaattctggagacgctggcatatttctctaagttcctggttccgtgaatatgtatacattccgcttgggggaaatcgtaagggtctggtacggcagctgtttaatattatggttgtatggatgctgaccggtctgtggcacggggcaaactggaactttgtactctggggtgtgtattatggtgtgcttctcatgattgaaaagttgttcctgcttaaatggctggataaacttccaaattggatcgggcatatttacagcatgtttctcgtggttattggatggacaatttttgcacagacggatattcaccagctgggagaatatttaaagacaatgtttggaatcggacatgtggcagttgcggattctgatttcttatatttccttggaagtaatgcggtacttctggtggcattgatcgcggcatctattgattaccgtgtctggatgcgcagattaaagcagggaaaggatgctaccgtttacgatgcgattgcaacgtcgaaaggatggaccatagcaaagccggttctcatggttgtgtttttgctggtgtcctttgcatttctggtaggagacagttacaatccgtttttatatttccgtttttaggaggcatagatcattgaaaaaaatcagtgtgacaatgattgtcatttttgttgcgtttcttgcgctggtatccggtggaagcctgctgatgaaagatcgtgagttctcaccgaacgaaaacagatatctggcggaaccgcccagactgacggttgacaatatattgagtggaaaatttcaggatggtcttgaaaattatctcagggatcagatctgttttcgcgatggatggatcacggtaaaaaccggaattcagaaagcctgcaaagacacagatatcggaggggcttatgtgggaaaagacggctatgattttgaaaaaatcacaccggaagatgtggatgaaaaacagattgcccgcaatgtgaaagcggtgcaggattttttcgcaaaagcttctgaaaatgtagaaaaggaccggatatcttttctgcttgtcccgtcatccgggctggtaatggccgataaacttccggcacatgcaaggctgtttgatcaggcaaagtatattgaccaaattgaaaaacagatgaaggactgtcgtgtgacagatgtgagggaaaaactgctttcccataatgaggattatatctattacaaaacggatcatcactggacgagtgagggcgcttaccttgcctatgaaacatggtgtgacagtaccgggatggagagcacgccgctggctgatctgaaaaaacaggttgcaaccaaaaaattccgtggaagcctgtattccaaaatactggatgcggattcggcatatgacagtatctggacgtatggagatacgaagcagaagacatacggaagtgactgcagtctgacaattgatgaaaagaaacagacggacagctgttacgatacagcgcagctgagtcaaaaggataaatataaatactttttcggagataattacggaacggtacagattgtatcagaccatgccagacatcaggatcgcaatctgctcgtcatcaaggattcgtttgcaaacacctttgtgccgtttgcaacagaaaactatggacagattaccatgattgacttacggtattataatgaaaatgtagaggaatatatgaaagaacatcagattacagatgtactcgttctctataatattacaaattttatttcagaccggaatctgtataaactggtcggaagaatttaaaatggaaaagaggtaagataaatggtttataagagagtaagtaaaataatctttgctgccatacttgccgtaacggtgttttcgggttgcgggaacaggcaggaagaaggaatagataagacagaaacagagaccacaacacagaaaagcacacaggattccacacaggatgtcacgcaggaagcggaagaggaaacaaaatatccgtccatcacttcggatggaaaaatgaaagattacaaaagtgttgtgacagtggatgatacagcatatgagttatacacatatctggacaaagtagcagacaattatgcaaaaagtgtaaataaggtagcggatactctggccggaaaatcggatgtgtatgatcttgtcattcccctcagttcgggaattacatttccggataatttgaaagacaaaatctcgtcttccgatcagcatgacgcaatgcagaagatccaggcaaaaatggacaaacatgtaaaaaacgtggacgtatatgacgtgcttatgcagcatcggacggagtatgaatattttcggacggatcatcattggacgacacttggtgcttattacgcatatacggaattctgtaaagcaaaagggattacgccggaatcgctggatgcatatagtaaaaaacaggattttgacggatttctgggatctttttacaatgatacttcggatgcaaagctgaaggcgaatccggatactgtgacagcatattacccaaatgctgagagcatatgccatgtgacggcatcggatggcaaaaaatatgactggccggtaatttatgatgtttcgaattacaatgcgggactgaaatacagtacgtttattgcaagtgataatccatacacggaaattgagaacaaggatctgtcggatggaagttcctgcattgttgtaaaagaatcgttcggaaatgcatttattccatttctggttgatcattatcagacggtgtatgtcgtggattaccgttattggacaggaagtatcagtaaacttgcacaggacaagaaagtgaatgatgtgctgtttttgaataatctttccatgattcgcaataaaagtctggtaggaaagttatacagagtgctataatacattacagtaaataattccgtacagacgatacgaaaggaggggaatccggtggttaaatattacagaacagatgaccgaaagattcatgaagaaccgacaattcaggatggcgtatgggtgcagatggtaaaccccagtgtcgcggagggacagatggtcgcggatgctctggatatggatgttgaagatgtgctggccgcactcgatgaagaggagagttcccgtatcgagctacaggatggttatacgctcattttggtcgatatcccgtcgatcgagatccgtcatgaaaaagaatcgtatacgaccataccgcttggtattctgattacatcgggtgagatcgttacagtctgtacggaggatacaccggttcttcaggcgtttttgaataaccgtgtccgggaattcagcacgaaaaaaaagcttcgttttgtctatcagatcctgtaccggattgcagtgctttatcagagtgatcttcgtatcatcgacaagatgcgtacggagatcgaggaacgtgtcggggatgatacggaggaagtggatctgattgcgctgcatgaactggaatcgacactggtctactttgcgacatcccttcgtgccaacggagtagtgcttgaccgcctgacaagatacaagcggctggagcagtatccggaggataaggaactgctcggggatgtaatcgtagagaaccagcaggcaattgagatgacaagtatttaccgtgacatcataaacggtaccagagaattgttgtcatcggtcatcgacaaccggatgaattccatcatgaaatcgctgacagtcatcacgcttgttatggcgattcctacggttatttccggaatttacggtatgaatgtcaacgagcactgggtcccgtttgccaatactgcgcacggatttgctattatcatcggaattatggtgatcatttgtgtgattatcctgcttcttctgcgaaagaagcgtatcctctagcggattgaattgcggtattgcagaggcgggacatgaaaagtatttttaaatgtccggataaaatagcttacgtttggaaagccgctctgcagtgctgtctctgtgatggagagacttgtggtttccagcagatgctttgcgtgggataaccgcaggtacgtgatatactgcgagagcgtaagctggaaatgttcccggaaataccgggaaatatatttttcggacatatggaaatgtccggcgagatcgtgcagagaaatgcgaaaacagtaattttgctgaatataagataacaactctttctggagactgctggtgcttttggtatggctgggataaaacagatcctgttctgccataagaagcacaagtttcaggagaagaatgcgggtgccaagctggttttggtatccgtttttttggttcgcagcaatacggtcagagttggcgttgatgatctgatcaagcagaacggatgcctttgctactgtgtcgtgatcctctggaagtttacagggaaaggagagggtgtggttccgcaggggaaagaaaagttcccgttccaaagaatcatccgactgaaatgaaataaattcgagaggaaacaggagggtgtagtagtcgacatccccggctgccgatcccatcagatgaagctgccccggagcaacaaaatagaccgaaccgtcctcagcagtatattctttcccgtcaatcaggaggtttaaaggtccttttttcgtgtaaataacttcaagctcatcgtgccagtgtacgggaatctgaaaagcatggaaaatattgtgcatgtgatattgtgtataggggtaattgtctgtgccgtgcggacggttttccttgagttccggatacatgaagtccctccttctgtcagtttcctaaattataatggaaaagtagaaataatgcaattataaggcgataaaatgcaagcattttttgaaaaaagggcataaaatgaatacgaaagaaaggagataccataaatggaacagaggagaaaaaatttaacgcagctttttattcccatttgtctggaaacacttttgtatatgctttcgggaatggttgataccctgatgctttcgtctgtaaatgatcaggcggtaggggcggtgggaactgcgaatacatatatagggatttttattattatgttttctgtgatttcctccggaatggtggccgtcatgacgcagaatatcggggcgggcaggccgggggtggcatatcaggccagacagcttggactggtatttaatgcagcgcttggcgtaataatgtctctgttcttatcactcggtgcagggaccattctctctggggtcggtgtggcagatgcgctgatgcagccggcgaaaacttatctgcagatcgtgggcggattttgtattttaaatgcactgattcccatctgctcgagttatcttcgggcatttggtttttcgaaggaaccgttgtatgcatccattatcggtaatgttattaatttttgcctgaatgcatttttcctgtttgtactgcacaaaggggtagcgggtgttgctaccgccacggtgatctcacgcatcatcaatctggtgattgttgtactgcttggtgctgttttggtgaaagcaaaacagcatccggagagagagagcaaccgggcagtgatgggacagatcatccgtatcgggcttccgtccgcatgcgagacggcgatctataacgtttccatgacgctggtgatccgtttcctgaatcagatggatgcgcaggggcttaatgtgacagcgcgttcctacacaatgcagatcacaaatttttcctattgtgtaggtgcggcacttgcacaggcaaatgcaattatgacgggatggcatatcggtgcgaaagagtatgatgcgtgtgaccgtggaacgaaaaaagcagcggtgatcggagtgattgttgcagttattctggagacggtgtttacgctttgttccggctggattatgcagctgttttccaaagatccgcagatggtgtcgcttgtcggtaaacttctggcaattgacatcgtacttgagataggccgtgtaaccaatctggtgtacggacaggcattaaagacaagtggggatgccgtattcccggtagtgatgggtgcctgctttatgattttgtgttcagttgggggaacgtatctgtttggaatccgtctgggccttctggccgtgggcgcatacatcggtatgactggtgatgaatgcgtccgtgccgttggcatgtaccttcgctggaagagcggaaagtggaaagaaaagggattggttaaatcccggtagcttcgtagcgcccactggcaccacatggaagaaccagtccgttggaggaaaccggaagaccgatctcgctggcggtgactgtaccattggcggtaccaagcaccgtgcttatcatataggaaagaactgccggctgcagaccggtggtatatgagttaatcaggaagaagagcggattgtccgttaaaatctggctgcagagctggatgagcggataaacgctctcttctattttccagatttccccttttggtccgcgaccgtaagacggcgggtccatgataatggcatcataatggttcccacgacggatttcccgctctacaaatttgacacagtcatcgaccagccaccggattgggacatctttcagaccggaagaaattgcattttcttttgcccaggtgaccatgcctttggatgcatctacatgggttacgcttgcacctgccgcagcggccgcaagtgttgccccaccggtataggcgaaaagattaagaaccttaacctggcgtcctttggaaacggcgtctgcaatgagctgggaaaaccagttccagttggcagcctgttccggaaataatccggtatgtttaaaactgaaaggttttaaatgaaacgttaacttcttattaataggcagggaatattgaatggtccattcttttggaagctggaaaaattcccattctccacctcctttggaactgcggtggtagtggccgttcattttgtgccatcctgtttcctttttcggggtatcccagattacctggggatctgggcggacgagaagataatctccccagcgttcgagcttttctcctttggaacaatcgatcacttcgtagtccttccattgatctgctaaccacatatgtcatatcctcctgattttcatctgtataaaacagtaacattatatgaaaaatagaaaaaataatcaatcattaaattttggggcgaaaaaacgtaaaagaaaaaataaaaaaagttcttgcttttttgaataagaccatgtataatatcaattgctgtggcatgatagctgtgaagcgcgaggttgctgcttataaattagcaggttttccgtggagcgaatgtcaagttaggaaactgacgacaagtcactgtacaaacaatatggtctatcaaagatagaaacaacgtgtgaaaaaatgcgaatcgcctgacgatggggcgatacatcagagatgtaccgcaggacacacacggagaagtgtacagtcaccgcttgtcgtactatttacaaagtgcgaaaaggaggcgactttttttatggcaagtcaagtaatgagaatcactctcaaggcttatgatcacgaattagttgattcatcagcaaagaaaatcatcgagactgtaaagaagaacggatcacaggtgagcggaccggtacctcttcctactaagaaggaagtagttacaattcttagagctactcacaagtataaagattcccgtgaacagttcgagcagagaactcataagagactgattgatatcgttacaccaactcagaagactgttgatgctttatcacgtcttgagatgccagcaggtgtttacatcgatattaaaatgaaacagaaataataactgtttcgacaaattatttcgtaagtcctgattagttatttcatatagatatggctgctctaggatgaacggttccgctactccactgcagatcagcaggtgggcaagaggcgttccgctgtagaaaacaggaggttaaacaatgaagaaagcgattttagcaacaaaagtcggaatgacacagatcttcaatgcagacggtgtattagtaccggttactgtattacaggctggtccttgtgttgttactcagattaagacagtagacaacgatggatacagtgcagttcaggttggatttgttgacaagaaagaaaagactgttaacaaagatgccaacggaaagaaagaaattcgcaacagacatggcgtaaacaaggctcagatgggtcacttcgctaaagctggtgtatctggtaagagattcgttcgcgagttcaagtttgagaatgcagacgagtataagttagcagatgaaatcaaagctgacatcttcgcagaaggtgacaaggttgatgttactgctatttcaaaaggtaaaggtttccagggtgctattaagagattaggtcagcacagaggaccgatggctcatggttctaagttccatcgtcatcagggttctaacggtgcatgttcttctccgagccgtgtattcaagggaaaaggaatgcctggacacatgggtagcgtaaaagttacaactcagaatcttgaagttgtaagagttgacgcagagaacaacttactgctgatcaagggtgctgtcccaggagcaaagaaagctctcatcacagtaaaagagaccacaaagtctggtaaatagtgcaaagtaagaaaggaggaactttacgatggctaaagtagctgtttataatatggaaggtaaagaagttgattctatcgaattaaacgattccattttcggcgtagaaattaatgagcatttagttcatatggctgtgcttcagcagcttgcaaataatcgtcagggaacacagaaggctaagacacgttctgaagttcgcggtggcggaagaaaaccatggagacagaagggaaccggtcatgcaagacagggatctacacgttctccacagtggacaggcggcggagttgtatttgctccaacaccaagagattactcattcaagctcaacaagaaagagaagagagctgcattaaagtctgttctgacttctaaggtagcagagaacaagttcgtagttgttgatgagctgaaattagatgaaattaagacaaagaagttcgtacaggttatgaacaatctgaaagttgagaaggcacttgttgtattaaacgacatggacacaaacgtgatcgcatctgcagcaaatattccaactgttaagactgctcagacaaacgagctgaatgtatttgatgcattaaagtatgacaaggtagttgttacaaaggctgctcttgcaacaatcgaggaggtgtatgcataatggcaaacgtacagtattatgatgtaatcctcaaaccagtagtaactgagaagagcatgaatgcaatggctgagaagaaatatacatttcttgttcatccggatgcaaacaaaactatgatcaaggaagccgtagagagaatgttcgagggaacaaaggttgccaaggtcaacacaatgaattgtgaaggcaagaatagaagacgtggaatggtaacaggaaagactgctaagacaaagaaagcaatcgttcagttaacagaggacagcaaggatatcgagatcttcgctggattataattccaaaaggagcacttgcataagagttgcttcgcaagcaagtgcgtaggcaatgcatctacgatgcattacaagatatgtgtcagagatgacacgataatgaaaacatcgaaaggagaaaaacaatgggaattaagacatataacccatatacaccttccagaagaaatatgactggttctgatttctctgagatcactaagacaactcctgagaaatcccttacaacttctttaaagaagaacgctggtcgtaacaatcagggtaaaatcacagttagacaccagggtggtggaaacagaagaaaatacagaatcatcgactttaagagaagaaaagatggtattccggcaaccgtaatcggtgttgaatacgatccgaacagaacagcaaatatcgcactgatctgctatgcagatggtgagaaagcatatatccttgctcctgcaggattaaccgatggtatgaaggttatgaacggaccagaagcagaggtaagagttggaaactgtttaccacttgagaatattccggttggtacacagatccacaacatcgagttactgccaggtaagggcggacagttagtacgttctgccggactcagcgcacagctgatggctaaggaaggaaagtatgcaacacttcgtcttccttcaggcgagatgagaatggttccaattcagtgtagagcaacaatcggtgttatcggaaacggtgaccacaacctcgtaaatattggtaaggctggacgtaagcgtcacatgggtatccgcccaacagttcgtggttctgttatgaaccctaatgaccatccacacggtggtggtgaaggtaaggctccggtaggtcgtccaggaccatgtactccatggggcaagcctgcacttggtttaaagaccagaaagaagaacaagcagtctaacaagcttatcgtaagaagaagagacggtagagctatcaaataattaggaggtttatgaaatggcacgttcacttaaaaaaggaccatttgctgatgagagcttactcaaaaaagtagatgctatgaacgcttccggagacaagtccgtaattaagacctggtcccgtcgttctactattttcccatctttcgttggacacacaatcgctgttcatgacggaagaaagcatgttccggtatatgttacagaggacatggttggacataagctcggtgagttcgttgcaacaagaacttacagaggacatggaaaagacgaaaagaaatcaggcgtgagataaaataatatttagtggaaggaggtttcatccatggcaaaaggacatagatcccagatcaagagagagagaaacgaagtaaaggacacaagaccttcagctaagttatcttatgctagagtgtcagtacagaaggcttgcttcgtattagatgcaattcgtggtaaggatgttgcgactgcacttgcaatcgtatcctacaacccaagatacgcttcaagcgttgtagagaagttattaaagtcagcaatcgctaatgctgagaacaataacggaatgaaggcagaaaacctttatgtagcagagtgctacgcaaataagggaccaacaatgaagagaattcatcctcgtgcacagggtagagcttatagaatcgaaaagagaatgagccacattacaatcgtgctcgatgaaagataggaggcaatcatgggacagaaggttaatcctcatggattaagagtcggcgttatcaaagattgggattctaaatggtatgcagatggagatttcgctgattacttagtagaagattacaatatcagaacatttctgaagaaaaaattatacgcagctggtgtttctaagattgagatcgaaagagcatcagatcgtgtgaaggttatcatttacacagctaagccaggtgttgtaattggtaagggcggcgctgagatcgaaaagatcaaggcagaagttcagaaacttacagataagaagttagttgtagatatcaaagaagtaaagagaccagatcgtgacgctcagttagtagctgagaacatcgctttacagcttgagaaccgtgtttctttccgtagagcaatgaagtcctgcatgggccgtgcaatgaagaccggtgcaaagggaattaagacttcctgctcaggacgtcttggtggagctgatatggcccgtacagagttctactctgaaggaactataccgcttcagacacttcgtgcagatatcgattatggattcgcagaggcagataccacttacggtaaagtaggtgttaaggtttggatctaccgtggcgaagtgcttcctacaaaggctaataaggaaggaggagctcagtaattatgttaatgccaaagagagtaaaacatcgtaaacagttccgtggttccatggctggtaaagcaaccagaggaaacaagatcacatacggtgagtatggtatcgtatcattagagccttgctggattaaggcaaatcagatcgaggcagcccgtgttgctatgacaagatatatcaagcgtggtggtaaagtctggatcaagatcttcccagagaagcctgtaactcataagcctatgggtgttcgaatgggtaaaggaaagggtgcccttgagtattgggtagctgtagttaaaccaggtagagtattatttgaaatctccggtgttccggaagacgtagcgaaagaagctttacgtcttgctacacataaattaccttgcaaatgtaaagtagtttcacgtgcagatttagaaggcggtgagtcaaatgaaaactagtgcatatttagaagaattaaagtcacttactgttgcagatttacagtcacagttagttgatgcaaaaaaggaacttttcaatttgagattccagaatgcaaccaatcagttagataatacagccagaattaaagaagttcgcaagaatattgctagaattcagactgttatcaccgagaaagctagcgttgctgaataaatccaattctcagaaaggagacttcggtcgtggaagaaagaaatcttagaaaaacacgtgtaggtgttgttgtaagcgataagatggataagacaatcgttgtagctgtaaagaacaacgagagacatccactgtacaacaagatcgttaaaaagacttataagttaaaggctcatgacgagaacaacgatgctaagatcggcgataccgtcagagttatggaaacaagaccattatctaaagataagagatggagacttgtagaaatcatggaaagagcaaaataataaaaggaggctacaagcatggtacagcaggaaagcagactcaaagttgcggacaatactggcgcaaaagagttacttgttatccgcgtaatgggtggatctaccagaagatatgcgaacatcggcgatgtgatcgttgctactgttaaagatgcaacaccaggcggtgttgttaaaaagggcgatgttgtaaaagccgtagttgttcgttcagtaaagggtgcccgtcgtaaagatggttcctatattaagtttgatgagaacgcagcagttattatcaaggacgacaaaactccgagaggaactcgtatctttggaccagtagctcgtgagcttcgtgagaaacagttcatgaaaattgtttctctggctccagaagtattataggaggaacgaagatggcaagtatgaagatcaaaaaaggcgatatggtaaaagttatcgctggcagagataaagacaaagagggcaaggttattgccgtaaataaaaaagacaacacactcctcgttgaaggcgttaacatggttaccaagcatgcaaagccaagcatggcaaaccagcagggcggaatccttcatcaggaaggacctattgatgcatctaacgtaatgttccttcacaaaggaaaagctacccgtgtaggtttcaagatggacggagacaagaaagtacgttatgcgaaatcaacaggcgatgttatcgattaattgaagagaggaggacaaaacattgagtagacttaaagagcagtacgaaaatgagatcaaagacgcaatgatcaaaaagttcggatacaagaatacaatggaggttccaaagcttgacaagatcgtagttaacatgggtgttggtgaggctaaggagaacgcaaagcttcttgaggcagctgtaaaggacatggaggctatcaccggtcagaaggctgttacaacaaaggctaagaacgcgatcgcaaacttcaagatcagagagaacatgccgatcggatgtaaggttaccttacgtggcgagaagatgtatgagttcgctgatcgtctgatcaacttagcattacctcgtgtacgtgacttccgtggtgttaatccaaacgcatttgacggacgtggaaactacgcacttggtatcaaagagcagattatcttcccagagatcgagtacgataaggtagataaggttcgtggtatggatatcatcttcgttacaactgcaaagacagatgaagaggcacgtgagttattaactctgtttaacatgccatttgctaaataatcaggagggaatttttaatggctaagacaagtatgaaaattaaacagcagcgtaaaccaaaattctctaccagagaatatacacgttgcagaatttgtggacgtccacattcagttttaagaaaatacggaatctgtagagtatgtttccgtgagttagcatataaaggtcagattccaggcgttaagaaggcatcctggtaaacctttaagagaaaagttgtagtccaaaaggaggaaaaatgtcatgatgatgacaagtgatccaattgcagatatgcttacaagaatccgtaatgcaaatactgcaaaacatgatacagtagatattccagcttctaagatcaaagttgctatcgctggcatccttgttgatgaaggtttcatcgagaagtatgacatcatcgaggatggtaacttcaagacaatccgtgtcacattgaagtatggcgctgataagaatgagaagatcattacaggaattaagagaatttccaagccaggtttacgtgtatacgctggcaaggatgaaatcccgagtgtacttggtggattaggaatcgcaatcctttctacgaaccagggaatcgttaccgacaaggaagcaagaaagcttcaggttggtggcgaagtattagcatttgtatggtagtcaaaaccagatagaaactattaacatccaataaatacaggaggtacgggcatgtcacgtataggaagaatgccaatcgcaattccagctggagtaacagttgagatcgcagaaaataatcatgtgactgtaaaaggtccaaagggtactttggagagaactcttccatcagagatggatattaaggttgagggctctgaagtcgtagttacaagaccaaacgatttaaagaaaatgaaatccttacacggattaacaagaacactgataaacaacatggttgttggtgtaactgatggttacaccaagacccttgaggtaaacggtgtaggttatagagcacagaagtccggaaagaagttaacacttcaccttggatattctcatccggttgagatggaagatccggaaggacttgaggcagttgttgaagataacaagattatcgttaaaggtattgacaaagaaaaagttggccagtacgcagctgaaatcagagataagagaagacctgagccatataagggcaagggtatcaagtatgctgatgaagttattagacgtaaagttggtaagactggtaagaaataattaaaggagtggacaagaaatggttagtaaaaagtcaagaacagaagttcgtgaaaagaagcatagcagaatgcgtaatcatcttgcaggtacagcagagcgtcctcgtttagctgtattcagaagtaataaccatatgtatgctcagattattgatgatacagttggaaatacacttgtttctgcttcaactctggataaagatttaaaggcagagcttgagaagactaataacgttgatgcagcagcaaaacttggtactgttattgcaaagaaagcattagataagggtattaccacagttgtcttcgatcgaggcggttttatttacgcaggcaaggtaaaggcattagctgaagcagcaagagaagctggtttagagttttaggaggagacaaacatgaaacgtgaaatcattgatgcgagtcaattagaattagttgaccaggttgttgacatcaagcgtgtaacaaaggtcgttaagggtggacgtaacatgcgcttcacagctctcgttgttgttggtgacaagaatggtcatgttggtgcaggtcttggaaaggctgctgaaattcctgaagcaatccgcaaaggaaaagaagatgcaattaagagcctcatcagtgttaaattagacgagaataactctattacacatgatgtaacaggaaaatacacaggtgcttccgtattattaaagaagtctcctgaaggtactggtatcatcgcaggtggtccggctcgttccgtatgtgagcttgcaggtatcacaaatatccgtacaaaatcattaggatcaaataataagcagaacgttgtacttgctactatcgaggcactttctcagttaagaagcccggaagaagttgcaagacttcgcggtaaatctgtagaagaaatcttaggttaaggaggagcgactaagtcatggcagataaagtaaaagttacacttattaagtcaacaatcggtgctgttccgaagaacaagaagacaatcgaagctcttggattaactaagttacacaagactgtagagttaccaaacaacgcagctacacagggcgcgcttcgcaaggttgcaccatacgttaacgtagaagaagcatagaataaaataaggaggtgccaaaatggatttatctagtttaaaagcagcagaaggctccgtacacagcgataacttcagaagaggtcgtggacacggttcaggaaatggcaagactgctggtaagggccataagggtcagaaggctcgttctggagcaccaagaccagggttcgaaggtggccagatgccattatacagaagattaccaaagagaggtttcaagtgcagaaactctaaggaaatcatcggaattaatctttcagctcttgagaaattcgataatgacactgtagtatcagtagatacactgatcgaagcaggtatcgttaagaacccaagagacggcgtaaagattcttggaaatggagaatttactaagaagcttacagtccaggctaacgctttcagtgctagtgccaaggagaagattgaagctcttggtggaaaagctgaggtgatctaatgtttaagacactgcgtaatgcatttaaagtaaaggacattcgagatcgaattctttttacttttttgatgctgatcatcatccggatcggaagtgaacttccggctccgggggttgatggggaagtgtttaaacagtggtgggcaagccagtctgcagacggacttggatttttcaatgcgattacaggtggttctttcctgaatatgtctgtattcgcactgaatattacaccgtacattacttcatccatcattattcagctgcttaccattgcgattccgaagcttgaagaaattcagcgtgacggagaagagggaagaaagaagatggttgcacttacccgttatgtgaccatcgttcttgcattgattcagtctatagcaatgacaatcggtttttaccgtggtggatatctcaccggccagggacctttagccgttattgaggttattacaggacttacggcaggatctgcagttcttatgtggattggtgagcgcatcacagagaaaggtatcggaaatggtatttccattgtattggttatcaacatcatttcacgtatgccggaagatatgggaactctttggagtcagttcattgcgaacaaatccattccaaagggaatcgtggcaggcctgatcattattgcaatcatcgttgcaatggtagtattcgtagtagtacttcaggatgcagagcgtagaatcccagttcagtattccaagaagctgcagggaagaaaacaggtgggtggtcagtccacacacattccgcttaaggtcaataccggcggtgtaatccctgtcatctttgcacagtcactgttacagacaccagtgattatcgcagcgattcttggaaaaggtaatggaacaggtatcggaagcaagatcttaaagggaatgtcccagtctaactggtgcaatccggaagagccgatctacagtatcggacttgtggtttatattctgttaattatcgcgtttgcatatttctatacacagattacattcaatcctttggagattgcaaacaatatgaagaaagccggtggttttattccgggtatccgtcctggaaagcctaccagtgattatttaaatcagatactcaactacattgtattcatcggagcagttggtctgtccatcgttgcatttattccaattttcttcaacggtgtatttaaggcagatgtttctttcggtggtacatcaatcatcattattgtcggtgttgttattgagacaattaagcaggttgagtcacagatgagagttcgctattacaagggatttttgaacgactaattatattttggagatactggattccggtatctccatttcccttatgatacggggagcaattcttctatataaaaatatatcgtgtttaataacagaaatggagaaatgatatgaagattattatgttaggggctccgggggcaggaaaaggaacacaggcaaagcagattgctgcaaaataccagattcctcatatttccaccggtgatattttccgtgcaaatatcaaaaatggtacagagttaggaaaaaaagcaaaaacatatatggatcagggtgcacttgtgccagatgaactgacctgtgatctggttatggatcgtatccagcaggatgactgcaaaaacggatttgttctggacggatttccaagaacaattccacaggcggaagctttagatgcagcattaaagaaaatcagccagacgatggattatgcaattgatgttgatgttccggatgagaatattgtaaaacgtatgggtggaagacgtgcctgcttaaattgcggggcaacatatcatatcgtatttaatccgacaaaggtggaaggcaagtgtgatgcctgtggagcagaaaccgtacttcgggatgatgacaagccggaaactgtacagaagcgtctgtctgtatatcatgaacagacacagccactgatcgattattacaaggcacagggaatactgaaatccgttgacggaaccaagccaatggatgaagtgtttgccgatattgttgcaatcttaggtgaataagatgaaagtaacgatcaaatctgctgaagagattgaaaaaatgcgccgcgcgggggaaatcctcgctgccgtgcatcagaatcttgcaagagaaatcaaacctgggatgtctactttggacattgaccggttgggggaagagatgatccgcggatatggatgtattccttcatttaaaaattattgcggatatccggcgtccatttgtgtttcggtaaacgaagaagtggtacatgggattccgacagacgaaaggatcatcaaagaaggagatattgtcagtctggatgcaggagttatttatgaaggctatcattcagatgcggcgagaaccgttgcagtcggagaagtgagtgaggaggcaaagcttctgatcgaacggaccagacagtcctttatcgaaggaatgaaaaaagcagtagctggaaatcatctttatgatatttccgcagcaattggtgactatgcaaatcagtttggatatggagtggtcgaggatctttgtggacatggaattggcagccatttgcatgaagaaccggagatcccgaatttcagacagtcacggtttcgcagaggaattaagctgaaaccggggatgacacttgccgtggagccgatgattaatgtgggaaccaaagatgtactctggatggatgatgagtggaccgttgtcacggaagataagtcattatccgctcactatgagaatacgatacttattacagatggaaaaccggagatcctttctctgacagaagaggaaaagaaggccggatttttaaatctcttttaacaacaggaaaatggaaaagagtcgatacaggaggaaagaaagttatgtcaaaagcagatgttattgaagtggaaggcgtagtagtagaaaaactgccaaacgcttttttcaaagtagaacttgagaatggtcaccagattctggcaacgatcagcggaaaacttcgtatgaattttatccgtatcctgccgggagataaagtaacaattgaaatgtccccatatgacctgacaaagggaagaatcatctggagagataaataaaaaaatatgttgacttccacaaggtgtctgtgtataatattattcggacactttttggaaagtacctgaaaaatgcggaaaaccgcagaaacagggcttttatagagaaaggaggatttgctgtgaaggtaagatcatcagttaagcctatttgcgagaaatgcaaagtcatcaagagaaaaggaagcatcagaattatctgtgagaatccgaagcacaaacagagacagggttaattacttcttgacagaagaaccctgttatttgtgcgctatggtcagtttataacagactggcgaaagcagcatcgcgtttgcgatgaaatcattatgtgcggctgcagcgcagtgaatttgcgctgttcataataaacagaggcatagtctggtcttttttgctataataccgagtggcatgggacaaatatgcgaatatggaaatcctatttgtatgcacacatttcaggacgtgcaaccgtagctgtatacggatagggttcgggaaaatacgcggttgcaggtgtatttatgactactaaataatcttaaaaattttatggaggtgtaaacacacatggctcgtattgcaggtgtagatttaccaagagaaaaacgtgtagaaatcggtctgacttacatctacggaatcggtagagcaagtgctgaccgtatccttgaagcagcaaacgtagatcctagcacacgtgttagagatcttactgacgatgaggttaagagaatcagtgcagtcatcgatgagacacagactgtagaaggtgatttaagaagagagatcgctcttaatattaagagacttcaggagatcggatgctatcgtggaatccgtcacagaaaaggactgccagttcgtggtcagaagactaagacaaacgcaagaacaagaaaaggtcctaagagaactgtagcaaataagaagaaataagtttaatcagagaaagtaggttagtttagatatggctaagaacgttgcaaagaaaacaacaaaaaagcgcgtaaagaaaaacgttgaacgcggacaggcacacattcaggcatctttcaataacacaatcgtgacaattactgatactgaaggtaacgctttatcatgggctagtgctggtggtcttggatttagaggttcaaagaaatctactccatatgctgcacagatggcagcagaaactgctacgaaggcagctttaattcatggtttgaagacagttgatgttatggttaagggaccaggctcaggacgtgaggctgctatccgtgccctttccgcatgcggtcttgaagtagtttccatcaaggatgttactccagtaccacataacggatgccgtccaccaaagcgtagaagagtttaattaggaggtatcgattaagatggcagtgaataaagtacctgtactgaaaagatgtagatcccttggtttagagccaagttatttaggatatgataagaagtcaaagagaaatcttcagagaggaaaccgtaaggtatctgagtacggacttcagttaagagaaaagcagaaggctaaattcatctatggtgtattagagaagcctttccgtaattactataagagagcagataagatgagaggattaacaggtccaaacctgatgacaatccttgagtcaagacttgacaacgtagtattccgtcttggattcgcaagaacccgtaaggaagcaagacagatcgttgaccacaagttcgtaaccgtaaacggtaaggttgtaaacattccttcttacctggttaaggctggcgatgttgttgagattaaggaaagcaagaagaacattcagcgtatgaaagacatcgttgaggttgctggtggaagaatcgttccagaatggttagatatcgacgcagagaagctgcagggaactgtaaaagagttaccatcccgtgagcagatcgacgttccagtaaacgagatgcttatcgtcgagttatattctaagtaattagtttaacgcatcgtaaacccgagaaggagggactttgtagtgttcgattttgaaaaaccaaaaattgagatcgctgaaatttcagaagacaagacatatggcaaatttgttgtagagcctttggaaagaggatatggtactacacttggcaactctttaagaagaattatgctttcttctttaccgggagctgctgtaagccaggtgaagattgacggagttctccatgaattcagttcaatcccgggcgttaaggaagatgttactgaaattattatgaacatcaagaacctcgctatccgcaataacagttctacaaatgaaccaaaagttgcttacattgaattcgaaggggaaggcgttgttacagctgcagatatccaggtcgattcggatatcgaaatcatgaatcctgaattggagatcgcacatttaaacggtggtgcagactgcaagctctatatggaacttaccattacaaagggcagaggatatgtcagcgcagataagaataagacagaggatacaccaattggtgtgatcgcaatcgattctatctatacaccggtagatcgtgtaaatgtaacgattgagaatactcgtgtaggtcaggttactgattatgataagcttacattggatgtatataccaatggaactttagagccagatgaggcagtcagccttgctgcgaaagtattgagtgagcacttaaatctcttcattgatctgtcagatgctgcacagcaggcagagatcatggttgagaaagagaacgatacacaggagaaggttcttgagatgaatatcgatgaactggaattatctgttcgttcttacaactgtctgaagagagctggtatcaatacggttgcagagcttatcaaccgtactccggaagatatgatgaaggttcgtaaccttggccgcaagtctcttgaagaagtacttgcaaaactcaaagagttagggttacagttaaatcagggtgaagaataataaaaactggcggtgtcagtaatcccgatgagtgtgacaacgtcatagaacatttatggcttgtggtttgaaatgccacagaattaagaatgggttctgccagtaaatccaaagagtatggcaggataccccacaaatggaggaaaattaaaatggcaaagtatcgtaagttaagcagaacatccagccagagaaaggctttaatcagaggtcaggttactgctctgatcgctaatggtaagatcgtaacaacagaagcaaaggctaaggaaatccgtaaggttgcagaaggcctgatcgctgctgctgttcgtgagaaagacaactttgacgaagttactgttactgctaaggttgctcgtaaagatgcagacggcaagagagtaaaagaagttgttgatggtaagaaagttactgtttatgacgaagtagagaagaagattaagaaggatcagccttcccgtcttcatgcaagaagagaaatgcttaaagttctttacacagtaaagacaaatgacggaagcaagaagggtgcaaaggaagttgaccttgttgcaaagttatttgatgagatcgcaccaaagtatgcagaccgtaacggtggttacacaagaatcgtaaagattggtcagcgtaaaggtgacggcgctctggaagtattacttgagttagtttaaaatttgtcaatgagaaaccccatctgcgaaagcagatggggttttttatactaaaaagtgagaatccgcaccggttttgccgatgcggattttttaaatttatgaaatatgtgatttggagagcggataaggtttccgttggtcagttcgtccgatcagataatccacgcttgtgtgatgaaaatctgccagagaagagagaatttccgttggaatttgtcgctcgtcattttcatatctggagtaggttcgttgtgtaatatttaagattctggcaatctctgtctgtgttaagtctttgtcttcccgtaaatcgcgaatgcgtttatatatcaaatatttgtcacctcccccatgctaatagtatatgtgagaccaaaatggtctattgctgtttagaccattttggtctaaaatatttggaaggcacaatataaggcacatattgaaatgcttataaatattgataaaataaaagcgttacaaaagaaaaatggaggcaggaatgtcggagtttagtgacaagttatcagagtatattgtaaaaagcggatcaaatgtgtaccagcttgcaaaagaagcatctttagacagaacaacattgcagaagacggcaaaaggacagagacttccgtctttggattatattagggaaatatgccagtacataaaaatatccagtaatcaggaagaggaactggttcgtctctataagattgaaaagctgggacacagtacagtaaaagcatgggatgaaattcagcagattattcttgatatttaccagctcagaaaaaatgaaaaaagttcctggcatattcgttttgatgaattaagcctgaaaagttttaatgcccaaattgtgcagaaatgcgattcggaaatggattgtttaaaagcaattatgtgcgtcatggaacaggaactggaagatccggatcaagccgaaatttatatggatgtttcatgggcaagtaaactggtgttatgtcaattgaggcaaagtgagggaaataagtcggaaaaattaacttgccatcaacttgtgaatttaaagcagacagaacatgtaaaagacgggatgctggaaaatattcagatgctgcatcaggtacttccatatgcatttacaacacataatacctatgatatccgttatgcttatatcagtgaaaacagcgaagatcagaaattgcatttatgggaacattacattattacacgcagacatgtaattttgtgttcggaacaggattatcaaatgattgtcatttccgatgaaatgattgcaaaggcatacaggcaggaagtcgggcgtatgctgagtgcatatcgtccgctgttcagttatcaggggtattccggtgaaggggttcggaaataccgcgccttgcttgatcatgatgaaacacatgtaacttacgagggatttccgtgtctggcacttatgatccccgatgaaataaaaaagcagttgattgcagatccgcagattggaacatatgccacagcattttttgatatgccaaaagtaaaagaaaaccagtacattaatatttttggaatggaagaggtaaggcattttatgaaaaccgggcatttaccgggagtgtttgatcattatttttacgtggagtccatggaacttcgaaaggaaatgcttgaaaattttcatagaaaccttctggcgcatacacggcagtattatatgatcaatgaggataaatttaaaataaacagttcttttggaattgatgtatttggacaaaataaggtcgcattctgttcaacatctgacgagtttccatttggttttatctcaattgatgaaccgggcatcagtgaaatgtttgccagttattttgataatctggtacagtccaaatatgtatattcgattgaggaaaccataacaaaatgggaggaaatggtggaacagatagaaagagaaatagaagataggaaggaatgagctttttagtgcataggtactaaaaataaaaggcacaataaaaggcacatattgaaaagaggagagaaattgataaactgaaagagaaaaacgaaagttaggagcagttatgaaaacattgggtattattggtggtcttggaccaatggcgactgcatatttcatggagcttgtgacaggaatgacagatgtcgactgcgatcagaaacatattccaatagtgttacagagtattccgcagacaccagatcgtacttcgtacatattggatcatatacaaaaaaatccacttccgcaaatggtagaagccggaaaacggttgaaggaggcgggggcagcgtatcttgcaatcccgtgtgttacagcacattatttttacagggagctttgccggcaaatagatctgccaattatttctctgttggaaaaaaccgctgattatttcaggacagagggtgttgatgaggtggcaattctggcaacatcgggtacggtaatgtgtaagattatccagcaggaattaggaaaaaaacatatccagacgttgctgcctgatgaaagacagcaacagaaaatcatggagattatatataagcagattaaggccggacgctcggtagaaattgaagaatttgaacaaattggtacacaattacaacaacgaggcgcacagaaactgctactgggatgtacagaattatctcttttaaaaagagattttaccctgaatcaggcatatgcggacgtattggaaatattggcatctgctgtagttacctataacggattgccagtaaaagaatatcacagacagacacaggagataaaataatgcagagaaatgttttggaatatttggaagagacagtaaaaagagtgccggataaaatcgcatttgcaaatgataaaacgcagttgacatttcagcaattttcagatgacatacgtgcaattggcagtgaattaattcggaaaggttatcaaaaggagccggttttgatctatatgaataaaagcccggaagcattggaagggtttttcggagtgatcgaaagcggctgtttttatgtgccattggatgaagagatgccgaagagacgcatcgaactgattattgaaaatacgaaagcaagagttatcatctgtgatcaggagaatctgaaacgtgtaaaggaacttccttttgatggagaaattatgctgcatgaggaactggcaaagaaaagagaggacaaggaaaagctggataaggtaagaagaacagcactggatacagatccgctttatgtgctttttacttccggatctacagggatgccaaaaggggtagtgggacatcacagaggtgtcattgattatattgaccagctttctgcggtgttggattttgatgaagagagtgtatttggcaatcaggcacctctttattttgatgcctgtatgaaggacatttacccgacactgaagtttggtgcaacgacctggctgattccccatgaactgttcctgtttccggtccgtctggtggaatatctgaatgtacataaaatcaataccatatgctgggtggtatctgcacttacaatgatttctgcatttgggacatttaaagaagtagttccggaatatctgcgcacggttgcatttggaagtgaagtgtttccaatccggcagtttaatctgtggaaacggacattgccacaggtaagatttacaaatctgtatgggccgacggaggcaaccggaatgagctgttattatcatgcagaccgggagttttcggagaatgaggtgatcccaatcggacagccttttgaaaatacagaaattttacttttaaaaggaggtttagaggctgcgcagggggaagaaggagaaatctgtattcggggaacctgtcttactcatggatattatggaaataaggaaaagacgaaagaagcatttgtccagaatcccctgaatccgtattatccggagctgatttaccgtacgggtgatattggaaaaagaaatgcaaaaggagaactgatctttgtgtcccgtaaagattatcagattaaacacatggggcaccggattgaactgggagagattgaggcaaatgtacttctggtcgatggcattcagacagcatgctgcatttatccaaaagaagatgaaaagatcgtcctgttctatacaggaacgctgaaaaaggcagaacttctgatggaattaaagcagcgtctgccaagatatatgattccaaatgtgttgtttcttatagaacagcttccgcttactccgaatggaaaaatgaatcgcaaagcaatggagcagttttatatggatcataaaaaaaacaaaagaaggagaacaaaatagttatggaaacaagagaaatcattttggatattttacaggaaatgcatgaagatatcgattatgaaaaagaaaaagcattggtgacagataaaattctggattcttttgatctggtcagtcttgtctcggaattgaccgatgcgtttgatattgagatcacagcaaaagattttgtggaagaaaattttaattcgctggatacgctggtaactatggtaaaacgtttacaggaagaataaaacagggaggcggtatgctttttacatcatatgcatttattgcatttatcgctgtcgcattttttctgtattatcggattccacgcaaatggcagtggccgtttcttctgataatcagcattggcttttatgcatcggcaggaattttttatcccatctttttacttgtaagttcggcggtgacctatctggccggactgtggatcgaaagaaaccgaaaacaggaaaaaacttacatccgggaaaatgccggccagtttgcatcgcggcaggagaaaaaggagtttaagcaaaaaggagaaaaacgtcgaagaaatcttatggtgtcagcacttctgatcttacttgctgttcttggagtatttaagtatgcggattttgtgattgacaatatgaatgctgttttttatgcggttggaagtgatcgggagctggaatatctggatttactgcttccaatgggaatttccttttatacatttcagtcgctgggatatctgttggatgtatattgggaaaaaatcgatgcacagaagaattttttcaaacatctgctgtttgtatcattttttccacaactggtacagggaccgatcagccgttattccgatttatcacagacgttgtatgaagaacatgtatttgacaaaaagcaggtgatatttggactggaaagaattctctggggatatttcaagaaacttgtagtggcagatacaatccttacagcaaccactgccgtgattggagatgaatattacaacggtgcgtgggtgctggtcggaattattttctatggcattgaactgtatgccgattttacgggaggcattgatattaccataggaattgcgcaggtattcggagtgaaggttgcggaaaactttattcgtccatacttctcaaaaaatattgcggaatattggcggcgctggcatatttccatgggaacctggttcagggactatattttttatccaatgagcatttccaaacgaatgggaaagctgacaaagttttgtaagactcattttggaaaaggagtagcaaagagggtgccggtttatctggcaaccatggttacttggtttgcaaccggaatctggcatggtgcaagctggaactttgtcatgtggggcattatgaatggcgtgatcatcctgatttctcaggaactggaaccgttgtatgcgcggtttcataagcagtttccttcacttggacaaagaaaaggatatcaggcatttcagattgtgcggacctttttcctgatgggatcgcttcggatgtttgattgttacggggatgtgcctcttagtttttcaatgttttttagcatgttccgggactttgatcttcgtgcgttgaccgtggatgagtttttggatctgggactgaatatcccacaatatgtgattgtgtttgcaggtacggtgttaatgttttccgcaagcgtgatcggacgaaaggaaagtgtgcgtgaacaattgagcagaaagccgtatgttgtgagatatgcagcagtagcggcactgtttcttgccgttgttctgtttggatcttacggtgtgggatatgatgctgcgcaatttatttataatcagttttagatgaggagaaatgttttgaaaaccgctgttagaaggattgtttctgttggaatacttttgattttgctgtttgcaatgcagaggcttgtgatgccaaagtatgtggatgatgtgatcgaaggtggatttacagcagaatattatcgggaagaaaatccgcatgaggtgttgatggtaggagattgtgagttatatgaaaatttcagtccagtcacaatgtggaaaaactatggaattacaagttatattcggggaagtgcccagcagcttacctggcagtcgtattatctgttagaagacgcactgaaatatgaaacgccggatgtggttgtatttaatgtgttagaactgaaatataatgaaccgcagagagaggaatacaatcgcatgacgcttgatggaatgcgctggtcagtaagtaaggtacaggcaatccgtgcatccatgctgccggaggaacattttattgattatgtttttccactgctgcgttatcacagccgggttacagaacttaccgcaaatgactggaaatattatttcaaagacaaaacgcggacaactgccggttattatatgagagtggatacagcgccgtatgaagaaggaatctgggaggaagaagaaccggaaagtgacacgttggggaaaaatgcaatggcatatctggataaaatccggatgttgtgtgaaaagaaccatattcgtctgcttctggtcaaggcaccaagcaagtctccggtctggtatgacacctgggaatcacagattttggaatatgcgtccaaatatgatctggattatatcaattttttgaatctggtggatgaaatcggaattgattacaataccgatacttatgatcagggccttcatatgaatttaagcggagcagagaaatgtgcggattatctgggaaaatttctttcagaaacgtatggacttaaggatttaagatcagataaaacgatttattcggactgggaaaataagacaatattttatgaaaatatgaaaaaggcacagtataaggaactgaaaaaatacggagaaattgtaaactattaaagagagaaagaggttatagggatgaagaaaagtaagaaaattataagtctggttttggcaattgcaatggtattactggtaccggtcagtgttatatcggcagcaccaaagggatatggatttcgatatgccggagttacggtatatgttcatggaaaggcatccggactgatcgataagatgggcgagccaaataagaaaagcaagtcaaaaagctgtgcgtatgatggggaagatatcaaatatgtgtatgacgagttcacattggttacttatacagagaaaaacggtggcacagaatatgtacaatccatcaaatttacttcaaaaaaggcaaagaccaaagaaggaatcaagattggaagcaaagaaaaaacaatgaaaaagaaatatggaagagcacgcgacaatttcggcgtgtacacttacaaaaagggaaaaatgggaattacatttaccgttgatgatggaaaagtctctgcaatccagtatgtagcatattaaaagattttatacgagggagaattacttatgagaaaaaaaggaatgggaaaagcggcagcagtaattgctgcggcaatgctatttagtctgttttcggaagccggaattgctgcaccgcagatggtacaggctgcaacgtatcagaaaacgataaagaataaatcggtaaagaaaccggaagtgctggtcggtgcggataaagtaaaagtattttcaattaaggtcaaagaaattggcaaacagattcaggaagcagaaacaacagaaccgtctgacgatacaaaaaatcaagatggggaatccgcacagcaggaagaaaaaacaacggaaataacagagaaaacggaaacaaccgatatcacaacagaaacaacagaagaaaatggtggtggggattcggtcgaaaatatcgaagaagcccagccggaacaaccggaaattgtaagcattacctatcggtacaaagtaacagtgaatgtaaaaaataaagcaaaaaacgacattcgaaaattgctgctgaccggaaaagctggtggaaaaacgattacatttactgcaaaaaatctaaaagtgggaaagacaatgacactttccaaaaactttgaacttacaagtaaaacggaaagagatactccggaatttgaatgtcaaaaacttcaggtatatgcaggaagcatggtaagtacctatcgttatgccagcgataaattgagcagtgattatgcgacacccgataaaaaggcaccggaaatccgtggatttgttggaaagaacagctataatggaagcatcccatatcagaccatatacagtgatcaggaaaaaacctatgattatttcaaatatgtgtatgcacaggataatcgtgatgcaaagataaccttgaaggtggataccagtaaggtgaatttcaagaaaaaaggcacgtacacgattacttatacggcagaggacaaggcaggaaatgtcagtaagaaaactgcaaaaattgcagtgagggtaaatgattctctagatcagatggcagatacggttttgggacgtattataaaaaaagactggtcggatcggaaaaaagcgactgctatttacaattatacaagaggtcatattgcttataccggaaattcaaacaaatcaagctgggagaaagaggcttctaacggtctgcgctatggacggggagactgttttacttactactgtgtgtccagagcattgctcacgcgtgccggaattccaaatattgaagtgacgcgtgtgcaggggtatggacatcactggtggaatatggcatatgtaaatggtggtttttatcactttgatacctgcccgcgtaaggctggtggaagattttgtctggtgacggatgcgcagttaaaaaattattctgctacggtaggcaaacgttcccacatctgggcgtatagtcagaagccaaagtcaccagagaaagttttatcatcaattttttaagagagaacaggaggacgaacgatgaagaaaatgaagaaaatgaagaaaatgatgaaaaacatggtatgtatgctgttatgtgcagttatggcattatcagttattaccataccggaaaaggtaacagcagagacgacaacaaaaaatacattgtatcggtatcgtgaagtgaaaacaggtaaatttggatgcgtgaatcgaaagggaaaagtaattgtaaaaccgacctatgattttattgatacatttgttgacggtcttgcacaggtagagaaaaacgggaaatacggatatatcaatagcaagggaaaagaagttattaaagttcaatataaacaggcagatcggttttcagaaggtttggctttgatacaggaaggtaagaaatataaatatattgataaaacaggaagtactgtgattaatgtaaagggaaaatatccgtccgagttttcggaaggatatgcaagcctgcagataaacgaaaagtggggatatattgataagaccggaaaaatcgcaattgaaccaaaatatgatatggcatatagctttacggatggacttgctttggttagtgaaggtggcagggaaggattcattgacacagatggaaattatgtgatcaaacttacggacaaggtagactatgcaagtttttcggatggttatgctctgattaggaaaggaaataagtggggatttatagataagaagggaaatatcgttataaaaccggctttttatggtgcagctgatttcaaagaaggatttgcttcaattatggaaaaggtaggagacaaatatctgtcaggatatataaacaaaaaaggaaaaatgattaccaaagcaatctatgaagaggttgatgattttcaggaaggaatggcatgtgtaaagaaaaatggtaaatatggttttatcaacaagaagggaaaactcgttgtaaatgccatatatgataatgctttttcgtatgaaaatggacttgcatatgtagcaaaaggaagtaatgcctattttatagataaaacaggaaaaaaagtgattacgattaagtagttatggcaggccggtaaaaaggagtattttggctatatgaaacaaacgataaaatacctgtgttttatatttttatgtctgctggtaatattcggaaagcgtaccgaagcatcagcggctgtgcgcgacatcacggttgccgatgatgatcagatcaaggcggaagtttgtgtcggagatacaggtcgaattgttgtcacaggggacagcagcaggatcgtgggatacgaatatttaacatctgccatggatgattcggaattgatcacaatggatgcaaatggaaccttcacggtcaaggcaaagggggaagagaacatttttgtctacggccacgatgagaatgcggaagatattttttatgctaaaattacgcttatcattcatccggatatgagtggggttacgctaaaaaagtcatccataacgacctatttgccaaggtcatatcgggacacaaaaaatacttactataagcgggcagatattaatattccggtgaacagcacagagcttttggacgaatatgagcggcatacctcttttcagtatacatcatcgttagatggaacagatgatgtgtgggtgagtgcagaactgcggaacaataccattgagttgtcgattgaggcaacaaaaaactgtaaaatgaaaatcacgttcacaattgaaggaaaaacatttgtaattcctgtaaaagcaaaagtggtggaactttcaagttatggatgcttactggaaaaaggacatactcaaaaactcagagtgaaaggttgttcggaaaaaattgtctggaaatcttttgattccaaaattgcatctgtaagcaaaaatggtgtggtaaaaggaaagaagattggaaatgtattgatttcggcaaaactcggcgatcaatatgttggttgtgtcgtatccgttacgaccgcacagatcaaaaaagtttgtgccagagccagttatatgggaaaaaactggaaatacagtcaggcaaagcgcggacaaacgggatattatgattgcagttcgctggtgtggaaagcttataagccctatacaaaaatcaattttggaagtgcagcttatccgggaaccacaaaaacggaatctgcatggtgcagagatcatggaaaactgttgaaaggcggtttttcatggaaaaagttaaagcaaatgaaattcaatccgggagatattgtattcaaatcggaagattcttctcatccatatgcaacaacctatcatgtggaaatgctcacaggctatgtatgttatcggtttgataaaaatggagaaccgtggattgaaccgctttgggcgaccagagacagtgactatggtgcggaagagggggcgcttatggcaagaccgacaaagtgatttaaaagggaatagaaaaattctgggtagataaaagtcagtagctcgttggagttttctgactttttgttgttacggcgatgtcggggaaaaataaaaggtactgtcttttcataatgataatacaaaatctaatagaattacctgcttttttacgagaaagtattttaatatcaagataagtcagattatgcattagtgagggaaagatttagagaactgttccgtttattatagtatggattctctaaaaaagtaaaggaccaatagagggcacatattgtttgtcgggctagaaaggttataataaaattgtatatacataataaaggaggtttatggagatgaataacaaattgaaaaagattgttgctttatgtctggcatttgcgatggttgcaacggttgtgttgccggagagtgcatatgcaaagacaaagaaaacagcaaactacgtaacacgggcatacgtgctgcaacaggtagaaaaactcattggtgcaacacagacaagtgatgacgtgatacagatcaaggatgtcaagaaaagcagtccgtattataagacgatgtctattgccgtcaatgcgggattggtaaagctggatagtaaccagaaattgcatccgactaaaaaagcgaccaataagtatgtcgcatcagttcttgcaaaaatttctgagacaagtaccaaaaacgtgttgggaaagaagacagcagcgacaaaactgacaaagaaaagtttaaaaacattcttaaatcagaaattcccgaatgtcgtatctaaatctgatgccaagctgaaaaagggaaatgtaatcattaataaaccagtaacattgaatgatgcaaaaatcacaggagaccttgtgatcggagatggtgttgctgacaaagaagttgttttaaataatgttaccgttactggaaagacgattgtccgtggtggtggagaaaattccattattattaccgagacttcggatatttcggatatggtgatccgtcaagtgaacaacaaggtcagcatcaaggtaaaaggtgatgcgaaagtccgtatggtctatatcaatgatggttctaatgatgtaaatattgtgggaaccgttggcatcgttaatattgtaggtgaaaatctgaaagtcacactgacagatgcagtggtaaatacattgatagtagcggatacagcaaagaatgcagttgttgaggcagataagaattcaagtattaaggaagcgactttaaatgcagccggaacaaagattcagggggaaggcaaagttgaggcaattaatgtcaatgcaaatgatacggttgttacagtaaaagacgcaaagatcaatgtcaaggataatgttacacctccaaaaacaaatgcggataataatagtcagacaacaacggataccaatatcagtaatgataataattcgggtggcggttcctccagtggtggatcttctacaagtggaggctcaacttcaggtggaagcagcgaaaatccaagtactccggatgttccgaaggtaaattatgttacggatagtcggttcgcagatgggtatccgaaagttgtgacagataaagagaatcagaaaataactataacttacaaattaaaagatggtgtggcatctgaggaaaaacctgcaaagatctacaatcttgtaacagattataatacgaattgggatgctacgacagaggcggttcttcacggacatttgggtgtcgtgaatgagcaaacacatgaaatggttcctacggaatattacgatttcttaaagatcaccgatgccggggaacatacagtagactataaaattatggatcacgctaccagtgatggattaacaacctatagtgttattgactgtgatggaaaagtatcggataccccgacaaaaattgcatttgacagggacacggcaacgagtgttgtgaaaaataaggtatatgtatctgatgtttacattaataaggcaaaggatactgtttatttgtatcttagaagtgaacttgaccagacaactgtcacttcggctgcggcctttacaataaagaaaaatggtcaaacactgaacgatatcaggatcagcaaaatggaattgatgagcaaaaccggtgaaaagtccggtccttatgttgcatgtattaagttgtctttaaataaggcattggatgattcaactgtgaattattcgttatattatgctggtacagagattacagatactgttggaaatccattggaaacatttgaccgttcactcatgacggtatcggatgggattaaaaatgcatatacttcacaggatggtcaatatgtttcatttgaggttcctgtttatcagtggatgtcttatacaacgtatcaggaaatccgagacgatcttggcgtatatgtagatggaaaacaaatcaatcagaagaattggtcttattcatggtcaattggagatatgaatattcgggttcacgatacttcgcttacaaattctaaaaaagtagaattaaaatcggtcagtggaaaaacattatatacagctgcaggtgataaactggataatttaagtgccaacttagagaaagatcgtgaaggctctatttcatctgctgtatttgataaaaaaaataataaaatagttcttacattaacagagaatagttcatttgagaaaaattttggtttttacgattgtaattttatggtaaaaattgcaggaaaagagtatcgtttacgtggaaacagttatgttcgaccaagtaatgcgggatacataatagaaattgataaggataatttaaaacaccttgatctgtcggaagtatccgaattttccattaagtatgcgccaattatttctgcagatgaaaggacaaacgactggaatgatctttttgcttataatagtggaaaacctgtagacgcaacggattatattccggtaacaatccagtaatttgttctacaatctgttaatggtattgaaagggctgtaaaataaggttttaattaaagaaaagccagtcaagaaaaatgtttgtaccgcttccaaaaaagttagatctaaaaatctaacttttgggggcggtatttttatttttcatgaatttaacatccatcaatctcagaaaaatcaatatacagattatcataaatatttaacttaatggtagcgtcaacggaatattgaatatttaaaatattctgttcaaaaaatttacagtaactgttttgcgtgacaataagctgtggtaataacaaaacatttctctgccctttacgcgaaaaaattggtactttagacctaaaaataaaaggcacaatgaagggcacatattgatagaaatatcaggaatgttacaattaaatcagataaaattttaaggaggaacaagaatgaagaaaaaattatatagcgcgatattagcttcgattatggtgatcggaagcatttgcggagttgcaatacctgtttatgcaaaggaagaaacgaaaattatagatggaaatgattcatatgatacggcaacatatttggatgttaatggaagttattcggatgttatgtcggacagcaatgacgttgatttttacaagttgatcccggattcaaacggaaaattgtctataaattttgggcatgtatacggggagagtagtcatggatggaaagtaataatttataagtatcaggatggagaatatatagaattaagtgatacggtaattaaattagaagatagtgagaaggtagaattaccttttgtaggggtacagtatggatgcgaatactatataaaagtgcaaaattataattgggatgctgtaaataaagtatataccattaaaacaacttttattagatcagaacagtatgaaagagaagaaaatgattcttataataaagccacagagatgaagttgaattcgtcatatacgggaactcttaataacgataatgatattgatatttatagaattaatgcaactggaaatggaaaaatagaattaacgtttgaacatgtgtatacagacgatagtcatggatgggatattataatctatcgatatacaaatggagaatatcaggaattaagtaatgatagggttactctaaaagataatgaaaaatatagattaccatatattggtgctgtctctgatggaatttattatgtgaaaataaaaaattataattggcgtgctgtaggaaaagaatatgtaattcgaaacaattttcagcaatcagattactatgaaaaagaagaaaataacagttatacaacggctacagatttaaaaataggagaaaaatataatggaacacttaatagtaatagcgacaaggatttttggaaaattacagcaacaaagaaaggatatattaaattaagttttggacatgactatatagatgattatcatggttggaatgtatatgtttatcagtatgtaaatggtgaatataaagaattgagcagtcagacaatttcgcttaaggataacaaattaatacaattaaaaggaatttcagcacagtcgggtgggatatattatgtaacaataacaaattataactggaatgcagtgggggtaaattacacattaaaagcagcatattccataggaaagccatataatctgcgtggaacaatttctaaaagaaagataacattaaaatgggatcgcggaaatgcagtaaatggttatgaagtatattgcaaagttggaaacggaaaatataaaaaaatagcaaatacattaacaaacagttatacatataaaaaactttctaaaaagaaaacgtgctattttaaagtaagatcatatgtaatcaataatggggtaaaggaatacagcggttttacagctgttgtaaaagccagagcctgatggtaatgcaatcagaatttcttgacaaaggagaaaaatgaaaagaaaaataggaactgcggtgctgttaatggtatccatattaattatcaatgtagatgggacttatgcgaaaacttccaaaaacctactgaaaaatccaggattcgaaagttctgacttttccatgtggaaatataaaggaaccggaatggataagttggattattatacggaagatcctgttggaatctggaataaaaaagatgattgtcattccggaaactatacatttcatttctggtcgacatataaacatcattttaaactagaacagacaatttcaaaaaagaaacttaacaaaaacaagacatataaagcatcggtatatatacagggagatgaagtgggagcagatgcagagatatatttatatgttatagcagatggaaagaagtatgtttctggaatggtagaattggatggatggcaggattggaagaaactcaccattgataatatcagatgtaaaaaaggaaatgtgaaaataggtatatatgttgatcatgcagcagacggctggggaatgattgatgatttttattttggacaggaatgaaaaaacaggagtcggtgaagtaaatttgtaatggaaatctcatctgtgaaagcagatgggattttttagtttctttcagaatatagaaaattgaaattgataaattcataaaaactggatataattacattgtaagaaaagtaaggaatgtattaccgcgaaaggaggtttttatatggaattggcaaaagtgacgtcaaaagggcaggtgacaatacctattgaaattcgaaagaaactcgggattaagaatggtgataaaatcttgtttgtggaagaatctggaagaatatatatgatgaattcttctatggatgcattgcgtgaagctcagagagcatttgcaggagaagcagaaagacttggactcaaagatgatgatgatgtaatgacaatgattaaagaacttagggaagaaagtgtggtgaagtgaatgagaattatgcttgataccaatgtgttgatatcagcattgctatttcccggtgtaaagatggatgcaatgatgaattatatatttacacaccatcagcttgtgttgtcatcgtatgttgtagatgaattgaaacgtgtagttaaacgaaaatttcggggaaaggagatggcaacgaacaaattgcttatgatgatgagtttcgaatatgtctatactccaagtaaggtagaaagtggactctttgatatcagagatgcaaaagactatcccgtactctacactgcaattatagaagatgttgatgttttggtaaccggggataaagatttctcggatatagatgttgagaagccggaaattttatctccctcacaatttatggagaaatttttaacagcagatcaggaacaatagttacaaaaacagcaatggaatttgtcccgggcagtttctttggagggatggcaataatggcattatacaacaaagatatactgctctggacaatttttatttttcatcaatttaacatcgcatcaatctaagaaaaatcaatatacagatcatcataaatattcactttaatagtagcatcaaatgagtattgaatatttaaaatattttgttcaaaaaaattcacagtaattgtccggcggcggggatcaacgatccagtactcacgtacactcagagttacaaccagagaaaaaacaagttatatgtttttatgcagaaaattcgaaatagcataagagaaaagatgtttctgagtataatttttgaaagttatgggacatatgagcaaaaaatttattgaaatgtcccatttccaaagccaaggggacatatagacaaaaagtttattgaaatgtcccaccttcgaaaggtaacgggacatatgaacaaaaagttcagcgttatgtcctgtttttgaaaagtaatgggacatagaaaacaagaaagattgcatatgtcccagagagggaaaagtcagggacatagaaggaaagaaaaatcatatatgtcccagagaggacaaagagagggatatagaaagcaagaaaaattgcatatgtcccccaaatgccatcataacttttattgcatgacaagcgatgagaaaaattatcgccttaccagagaaaatttgacaaataccctataggggtataacataagtgcaaaaataaaaatctttcagataatacaaaaggagcagacacaatgatcaaaacaaccttaaaaattgacggcatgatgtgtggaatgtgtgaatcccacatgaatgatgtgatccgcaaaaattttaaaataaagaaagtgacatcttccgcacgggatggggagacggttatcatcagcgaagagccgattgatattccgtgggcaaagaaagtaatccatgaaattggttatgagatgaccggcagttccaatgagccatacgaaaagaaaggactgttccgcttcgggaaaaaataaggaggttttttaccaatgaaaaggcaaagcaaattctttggagagttcaagaagtttattctgcgtggaaatgtgatggatatggcagtcggtgttattgtcggcggcgcatttacgtccattgtgacatccctgaatgcagatatcctgactccgatcctgggaattttcggaggcacggacttttcttaccttacggttacgcttggaacaggagaaaatgcaccggttctgcattatggcaattttattactgcagtaatcaattttctgatcacggcacttgtgatttttattatattgaaagttatcaaccggatcacagaaaaactgagcacgttagcaggtatggaggaagaaaagccggaaccgacaacaaaaaaatgtccattctgttattcggaaattgatatcagggcaaccagatgtccgcactgtacatccgtactggatgagcaggaataaaaacaaaataataacactattggaagggagtgacagagccatcatggaggtcacttccttttcaaaatcaggcgagcatgaaattagaaatagaaaagaggaaaacaatatggacgaaaacacaaaaaagcgcttagaccagcagtttgcttttatccgggaaattgacagggaaaaatttattgggagacaaacctatttatcggatggcagacgaaaggaaaatgatgcggagcatgcctggcatatggcgatcatgaccatgctgctcagtgagtatgcgaatgaaccgattgatgtgcttcatacaatcggcatgcttttaatccatgatctggtggagattgatgccggagatacttatgcttatgatgaggagggaaagaagacacaggctgaccgggagaaaaaagcggccgaccggatttatggtcttcttccggaagaacagggaaagatgttgtatgatctgtggcttgaatttgaggcgcagaagacgccagaagcaaagttcgcgcgtgtgatggataatctacagcctatgatgttaaacgccgctacagacggcaaagcgtgggtagaacacggggtgcatctggcacagattatgaagcgtaacgagcatacagcagaatattctgaaactttaatggaatatgcaagggaaatgtttatacagccgaatcttgacaacgggcatatcatcgaggatgaaaagaaatagttcagggctgtaatgcagaacaaaagcgtgtgaaaaccagaaaattttcacacgcttttcgtctgcgtttttttatgagattgtcatgaaataattacgcattttttgcatcgttgtacttctttacataattcttgatacgatcgtatggattcaacagatcgctgatagaagaatcatgatttaaagtatcaatgatatatgcaatatatttactcatatcgcagctgatatagtactcacgggagagaagctccggagtctgataaatcaggtttgtggttactacacggtaaatcaggccttcttcgtatgctttatcgaaagaagcaagtccgtttgtgaataatccgaacgtagaaacaacgaaaatacggtttgctttacgcttctttaattcacgtgcagtgtcaatcatgctttcgccggaggaaatcatatcatcaatgatcagtacatctttgccttcgacgttggagcctaagaattcatgggcaacgatcgggttacgtccgtctacgacacggctgaagtcacgtctcttgtaaaacatacccatatcaatgccaagtacgtttgcaaggtaaattgcacggttggtggcaccttcgtccgggctgatgatcatcagatgctcggcatcaatggtcaaatcctttacgttctttaagatacctttgatgaactgataggaaggcattacattctcaaagccattcagaggaatcgcattcataacacgaggatcgtgagcatcaaatgtgatgatgttgtcgattcccatattgtaaagctcctgcagtgctaatgggcagtcaagagattcacgggcagttcttctgtgctgacggctttcatacaggaatggaagaatgacagtgatacggcgggcttttccgccgactgcagcaatgacacgctttaaatccgcaaagtgatcatctggagacatatgattggtatgtccgcagagtgaataggtcatgctgtagttcgtaacatctaccatgatatagaggtcatagccccggacagactgattgataacacatttcgcttctccggaaccaaatcgtggaatatgaggctcgatgatgtagctctctttgtgatattccttgaaagcaatatcgttgtgatgctcgtgttcgcgatgctctctccaggtggacagatagctgtctactttttttcctaattccatacagcttgcagtcggaatcagtccgagagtaccggttggcatggtttccaaaattctttcgtcgtttggcatgattttcctccaggtttaaattaattgataaacatatatgcatataatagacccataactatggggtattatctggaaatgatgcgtgtgcgtttctgtttgcggatatcttcttctgtgaacagattgataaacgtataggaatctaaaatacgtgaaaatgttcgttcagaataggactccttgatccgttccacacttaggttggtagaaataatggtggatttttgccggatcagccgttcattcacacacaaaaacagctgggaagaggtaaaagagttaatcagttctgttcccaggtcgtcgatgactaacaaatcgcagtcgaaaatgttctggtgtgtggcaattgcatcggaatctttttcaaacacacctttgcttaatatatcaaataattgaaatgctgtaaagtaaattacggaatatccgtggtcaagaagttctttggcaacacagtttgtcagaaaagtttttccgacaccggtttttccgtaaaacagcagattttttggcttgtgatcaaaatcgtcaataaaataatgacattcccgcaccgctttttgtgcggtttcataagaagaaagtcctgtcagcggatttttttcctctttcgaataaaaatcgtagcggaaattgtcaaaattttcaatacggagtatttggcgaatgttggactgggcatagacggtattgataattgcctgtttaaaacagtggcattttttcccgtcgatatacccgctgtctttgcaatccggacaggtataaaccgggtccagatagtctgccggatacccgcttgcagtaaggagctgctgccgttccagagacagggcacttagttcctgctttaaggaggccagtgcatgggtgtctccatcaagatgcagacgcgcctgacggacggaagaagatgcaacacttgcatcaatttccttcagacggggaagcttttttaaaacctccgcacgccgtgtttcgagaatatgacggttatgcagttggcgctcatcgtattcatgcatgatctcatcatactgtgcattggaaagcggcatttgattctccttttattgctcaacagatgatatgggagtgattatgaccggatcggagagtttaaaagcatggcttccagactcttatagtcattttcacgggattcaaagttattaaaattgtttttcttcggagaagcggctgcatttgctttcgctgcggctctctcctttttcttttgctgatgggtagcgtcgaggcgtttgacatcttccagagaatgtaccttgtcgttataccagctggtcagaatagaatcggcataactgaaacttgactgaccggtactggaaatggtgcgggcacaggcttcctggatcaatgacagatcaaaagcgtattctttggtccatttgcggatcatggctgtttcggaatcgataaggtttcttcctgtgatgccgaaagctttcatgacggcgtagtacgctttgctgcggacggcggcttcacttttggcctgttccacagaagtaatttttttctcatgccatgccagtgccactttattcagataacgaagatttgtatgtcctttgctgacgcaatattccaccagatagacgatcagttcggcagaaaagtgaagatcttcatgccagaataagatcgtgttgatatcattctcactgaatggatgccggatataggtttccacgacaaaaagcatttcctgaatatccggatttttctgaaattctgcgatttcatccagcgtataatggcggatctgcggttcctgcggctgattcgcaggctgggagcaagaaacgttttcccctgcagcggatgctggtgtttcttccaaagaaacagcagacggggcaggagaggaagatgcctcttccgtgtttgtggaatcttccggaaacggaagaagaccgattccgcacaatttaccgtcggcggtttcctccagagagaggagtccttctttctgccagtaacgcagtgcacgctgaatgtccatttctgtattgttaaatttgtcagcaatttcagaaattgtacaatttgatgcatgagaatggatgcaccgtaataaatataaatataccttaacaaattccccgtttgctgacggcataaagcggtcaataaactggttgggaacgattgtgtccgtggctggacaatcattgtgcagctgaatgtttatcatatgtcatagtacctttcttattatgcatttgtgattatagcacaatcattttccaaatggaagaagaaaaacacccgtaaatccctggtaatcagggggatactgattgtgaacaacattgtggataaagtggataagtccaccaaaacgtacaaattcaaaacggaaaggagtggataaatatagacaaaaaatccacacagaacgaagaaagaatcaacgtttctatgtggataatgtggataagttattttccaaggagggattcgccgatttctacgacatttccggctcccatggttatcaacagatctccgttcatacaattttttaataaaaacttttcgatctcttcaaaagaaggaaaatagtgcgcgtcttttcctttggctgtcaggcgctccagaatatctttcgagcttacaccgaaggtattctgttcgcgggcagcaaagatgtctgccagaacaatgacatctgccatggaaagtacttcggcaaaatcatccagaaaagctttggtgcgggagtaggtgtgtggctggaataccagcaccagacgcttatgcggatatttctgcgcggcggtcagtgtcgcgcggatctctgtcggatgatgtgcataatcgtcaatgatggtgacaccgtctacggttcctttgtactggaaacggcggttggcaccgtggaaagcgtccagacctctgatgatggcatctgtgctgattcccatggtacaggcaagggcgatggcggccatggcatttccggcattgtgtcgtccgggaacggcaagcctgatttcacagatggcctctttgttgtgcatggcggtaaaagaaggacaggctttgtcatcatatgtcagattatctgcataatattcacaggaatcatcaaaaccgtaggtgatgatctgctgtggaagtccgtcggtcagttcctgatggtctgcaatttctccattgataatggttgctccgtctgccagtgtattgccggcaaatttacggaaagaacgacggatgtcgttgatatccttgaaaaagtccagatgttctgcttctacatttaagatgatgctgtattttggacggaaattcaggaaactgttggtgtattcacaggcctccgaaacaaagattccggaatgaccgacacgcaggtttcctccgatagagggaagaattccgccaacagtgatggtcggatcggatttcgcagcaagaagaatctcactgatcatggaagttgtggttgttttgccgtgggttccggcaacggcaacggaattgttgtagttgtccatgatctgtccaagcagttctgcacgggagagcattggcagtccctgggatttggcctctgcaaattccggattatccggatggattgcggctgtgtagacaaccagatcaatgccgggaatgatattttcggcactttgtccataaaaaatctgagcacctttggatgcgagcatgcgggtaagatcggattcttttgcatcggacccggaaatcgtaaagcctttttccagaagaatttcagcgagtccgctcatgctgattccgccaattccgataaagtgaatatgaatggggtcattaaattttaatttatacatcaggattacctacctattttaataaagtttttttctattataccactctataaccaaaggcgcacccgaaaatatattgtgcattttgccaaaaaacaacaaaaaaactcagcatttttgtataaactgttgtacataaaaggataatatgatatactacagtaatagtaagaaacaaacataatatttagaacagacgaggagtgatgacgtgattaagaaagaaatgatagccatgcttttagcaggcggtcagggcagcagacttggagttctgacatcggacgtcgccaagccggcagtagcatttggcggcaagtacagaattatcgattttccactcagcaattgtatcaattccggaattgatacggttggtgtgctgacgcagtatcagccactccggctgaacacacatatcggcatcggcattccgtgggatctcgatcggaacaatggtggagtgactgtacttccaccgtatgagagaagcaataacagtgaatggtataccggtacagccaatgccatttatcagaatctgcgctatatggaaagttataatccggaatatgttctgatcctttccggagatcatatttataagatggattatgaggttatgctggacttccataaggcaaatcatgcggatgtgacgattgcaacgatgcctgtttccatggaggaggcaagccgtttcggaattgtgattgcggatgaaaacaaaaagattcaggattttgaggaaaaaccggaaaaaccgcggagtaatctggcatccatgggaatttatattttctcctggaaagtattaagagatgctcttatcgaattaaaagatcagcagagctgtgatttcggaaagcatattattccgtattgcttcaaaaacaacaagaggctttttgcatatgagttcaacggttactggaaggatgtgggaacacttggctcatactgggaagccaatatggagctgattgatctgattccggaattcaatctctatgaggagttctggaagatttacacgaagtgcgatacgattgagccgcagtacatagcaccgggggcaaaagtggagcgctgcattattggggaggcagcagagatccatggagcggtgatcaattcggtaatcggaccgaacgtatatattggaccgggggctgtcgtgcgggattctattattatgaaggataccagtatcggcagggatgtaacgatcgacaaatccataattgcagaaaactgcagaattgaagatggggtaacattgggaataggagaagcagcaccaaacaaattaaacgagagtgtttattcgtttggactggtaacgattggagacgattctgttgttccggagaatgtaaaggtgggcaaaaacacagccatttccggtgtgacagtaaaagaagattatccagacggggtattggcaggcggcgaagtaattattaaggcaggtgacagaaaatgaaagcagtaggaattattttggcgggtggcaataacaaccggatgggagaactgtccagaaaacgtgcgattccggcgatgccggtcggcggaagtttccgctgcattgactttgtcttaagtaatatgagcaattcgcatgtacagacagttgcggtactcacacagtataattcccgttcactgaatgaacatttaagttcttcaaaatggtgggatttcggaagaaaacagggtggtctgtatctgtttacaccaaccgttacggcagaaaacagtgactggtatcgtggcacggcagatgccatgtatcagaatattgatttcctgaaaaaccgtcacgaaccgtatgtgatcatatccagcggtgactgtgtgtataagatggattacaatgacctgctggagtttcatatcgcaaagaaagcagatattaccattgcgtgcaaggatatgccggcggatgcggatgtcagccgtttcggagtcgtccgtatgaatgaagattcccggatcacggattttgaggaaaaaccgctggtagcacaatccaatacgatttccacaggagtgtatattatccgaagaagacagctgatcgaaattctcgaaaaatcggcggaggaaaaccggtttgattttgttacggatgtgctggtgcgttaccgcaatgtaaagcgcgtatacggatacaaactgaacacttactggagtaatatagcaagtgtagatgattacttccgtacaaatatggactttttgaaaccggatgtgagaaagtactttttccgcgaagagccgaagatttattcaaaagtggatgatcttccgccggcaaaatacaatatgggatcggatgtcagcaacagtctgatcgccagtggatgtattataaacggcagggtagaaaattctgttttgtttaagaaagcgtttgtaggaaaaaattgcgtgatcaagaattcgattatcttgaatgatgcatatattggtgataatacgcatgtagaaaactgcattgtggagagccatggaacgcttcgggcaaatacattttattccggagacgatgctgtccggattgttgcagaaaacaacgaaagatatatgctctagggagagactagaagggggatacatatgcagattacagacgttagaattcgcaaagtggaaaaagaaggcaagatgaaagccgtggtatctatcacaatcgatgatgaatttgtcgtacatgatatcaaagtgatcgaaggggaaaaaggattgtttatcgcgatgccgagcagaaaagccggcgacggggatttccgggatatcgcacatccgatcaattccgcgacaagggatcagattcagggattgatactgaaaaagtatgaagaggtcttgcaggagaaggaataaacgattaaaataagagaaatgggactgtggagtaatccatggtccttttcttaattacagacgttttgaatccgtaattgcgaaacttatggatgggcggctcccgtgtggtggctggggctgctgcttcctgtggcgtgctcaacatccagaatcaagaatctgcagaaaatgaccgcgtggctcctttgatgatttgcgttcgttcaagtttcgacagcggcgcggcttgtgtccgtctggcagggacgcgtccgaaggatttcgtgtctgccttagcggagtgcttcaaaatactgtgcccgcgggtcggtttgcgaccacatttatgaaaggactgtcaaagtgttcatagggagacacaaccgggagcgggcgcaataaaatttttgaagtgctccgcttaggcagactagaaattctgagcgcatccctgccagacggacacaagccgcgccgctgtcgaaacgttgcccggacacaaaattagagccacgcaatcattttcgcaaattctaagattctgtctgaatcgcacgccacaggaagcagcagccccagccaccacacgggagccacccggcggtacctttcgtaattaacggacaaaaattcaaataaaaggagaattggatacatgtttttaattgcaggacttggaaatccggacaagaaatacgaaaaaacaagacataatattggatttgataccgtcgatgcactggcagaaaaatacaacatcagcatcacggagaaaaaacataaagcactgtgtggaagcggtgtgatcgaaggcgtaaaagtcatcctggccaaaccgcagacctatatgaatttaagcggagaaagcatcgcagaaatcgtgaatttctataagcttgatccggagagcgaaatgctgattatttttgatgacatctctttggcaccgggaaatatccgtgtgcgcaaaaaaggcagtgcaggtgggcataatggaatcaagagcattatttcaagtgtgggaacctcaaactttatgcgaattaaagtcggtgtgggggaaaagccacagggatgggatctggcagaccatgtgcttggccgtttttccggggaggaccgtgcaagggtggaagaagccatacgggatgcggaagatgcagcagtcctgatgattcagggggaagcagacaaggcaatgaatgattttaatgcaaaaaagcaggagaatacaaagtaagtgaaagcatttatagaaccgctgcaggaattgagcggatatgaagatatgacaaaagcggccatgcagccgggactggtgaccatcagtggctgtattgatgcacagaagccacatatgatttacacgcttggaaggacacgcagccggcgtctgatcgtaacgtttcatgagcagaaagcgaaagaattgtatgacgactatcgtttttttgatccatcagtggtgtattatccggcaaaggatgtgctgttttatcaatcggatatccgcggaaaccttcttaccgcagagcggatcagtgcattgcgggcaattcatgaaaatgaacaggtgacggtgatcacaacatttgatgccctgatgaatacgatgccaagggatgcacaggtgtgggacagtgtgctgcatattgcacagggagataccctggatctggatgcacttgtggaacagctggtgcggatgggatatgaacggcagtatcaggtggataatatcggtcagtttgcattaagaggtggaattcttgatatttttccgctgacggaagaaaatccggtccggattgaactgtgggatgatgaagtagatacccttcgcacctttgatgtggaaagtcagaaatctattgaaaatatagaaaagcttgtggtatatccggcatgtgaactggttctttcgaccgaagagaaagcagaaggtatccgcagactgttaaaggaagcagaagctttttccgataaattgcggaaagaaatgaaaaccgaggaagcctatcgggcactgtcacaggcaaaagaactggcacaggaatgggaagaattgtcggaaaccgcgggaatggatgcttttttgtcctatttctgcagggaacggtggagcctactggattattttgatccggcagatacatttgtgtttttcgatgagctgagccggagcgcggaacgcggacggcagacggaactggaattttcggagagcatgaagcagcgtctggaaatggggtatattctgccggggcagatgaacgaactgtttggctataaggaaatcatgggaaggcttgaaaaatattcctgctgtgcggtttccgcactggatatcaagacctgcggattaaaatccaatgggcagttcggcattcatgtaaagagcgtaagcgcatacaataacagctttgaacttctgatcgcagacctgaagaaatacaaaaaaaacggataccgtattattttactttcgggttcccgcacacgcgcgaagcgtctggcggaggatattttaaacgaaggactcaactgtttttatacggaagattacgatcacgatctggtggcaggacagatcatggtctgctacggaaaagtgcatcaggggtatgaatatccgatcctgcagtttgcagtgattacggatacggatattttcggggaagaaaaaaagaaaaagaagcggcaccgcacctatgagggcgaaaaaatccagcagtttacggatctgagtgtcggggattatgtcgtacatgaaaatcatgggcttggtatctacaaaggaattgaaaagatagaagtcgaccgaaaggtgaaagattacatcaagatcgaatatgcgggaggctccaatctgtatattcttgcaacacagcttgaccagatccagaaatatgcggggaaagacgcaagaaaaccaaaactcaataaacttggaagccaggagtggacaaaaaccaagggaaaagtgcgtggagccgtgcgtcagattgcacaggatctggtgaaattatatgccgagcgggaagaacagaatggctatatgtatggaccggatacggtatggcagagagagtttgaagaactgttcccgtttgaagagaccgaagatcaggtgcttgccattgatgcaaccaagcgggatatggagagtcataagattatggaccggctgatctgcggggatgtcggttacggaaagacggagattgcgatccgtgcagctttcaaagcagtgcaggagaataaacaggtggcataccttgcgccgacaaccattcttgcccagcagatttataatacgttttcccagagaatgaaggatttccctgtccgggtggatctgttgtgccgtttccgcacggcagcgcagcagaagaagaccatcagtgatctgaaaaaaggacaggtggatattattgtgggaacacaccggattctgtcaaaagatgtgcagtttaaagatcttgggcttcttgtcgtggacgaggaacaacggtttggtgtggctcacaaagaaaaaatcaaacagttaaagaccaatgtggatgtgctgacacttactgccacaccgattccgcggacacttcacatgagcctgatcggaatccgggatatgagtgttttagaggaaccgccgatggaccgtgtccctattcagacgtatgtcatggaatataatgaggaactggttcgggaggcaatcacgcgggaacttgcccgtggaggacaggtatattatgtgtataacaaagtaagggatattgatgaagtgacgtcacgcattcaggagctggtgccggaggcaaatgtggcatttgctcatggacagatgagagaaaaccagctggaggatatcatgtaccggtttatcaatggagacattgatgtactggtatcaacgacaatcatagagacgggactggatatctcaaatgtcaataccatgatcattcatgacgcggataatatggggctttcccagctgtatcagctgcgcgggcgggtcggcagatccaatcgtacggcgtatgcgtttcttatgtaccgcagaaacaaaatgctcaaagaggtggcggaaaaacgactggctgccatccgggagtattcggatctgggcagcggatttaagattgccatgcgggacctggagatccggggagccggaaatctgctgggagccgaacagagcggtcacatggaggcggttggatatgatctgtactgcaagatgcttcacgaagcggtgaaagaagcccggggagaagcaccggccgaacagtttgagacttccgttgatatccggacggatgcatttattccgtccacatatattgcaaatgagtcgcagaaactggatatgtataagcggatcgccggaattgaaacggatgaggaagcggaggaaatgctcgaagaactgattgaccgttttggggagcctccgaagtccgtgcagaatctgctgacaattgccagactcaaagcggttgcccacagtgtatatattaaggaaattgttcaaagagaagatctgttaaaaatcctaatgtacgaaaaagcaaagattcatgcacagcgtattccggagctggtaaaaacatttgctccatcactgaaatttgcggcagatccgaagggaccgtacttcacttaccgtctgggagcaaattcaagggaaaagaacagggaaattctggaagttctcaggcaattattggaacaaatgcacgtttttttgtgtgcggagccgtaaaagtgcttgcctgatgtagggaaaagaattataatactctggtatataggtgaaaagaaactcccgggaggaactatgaaagcaaaaaaagttacagcgattattttagctggtgcaatctgcgcagcagcttttaccggatgtggtataaatacaggtgcgacggcagcaagcatgaaaaatcagaccgtcacgatgggcatggcaaactttacatgccgttatcagcaggcaaatgtagaagattattataagagcatgatgggggccaaaagcagcagtgagctctggagcaaggatttatatggaaacggaacaaccatggaagacaccatgaaagattccgttatggaacagcttcatgagatgtatacgttacaggcacatatgaaagactatgatgtgagtgtgacaaaagacgaaaaggcagcaatcaaaaaagctgcacagcagtttatcagcgataattcttccgaggcactcaaggagatgactgcagacgaagataccgtggaggaactgcttacgctctacaccatccgcagcaagatgcagaaagccatcgaggcagaagcagataccaatgtgacggatgaagaggcaaatgagcgcggttatacgatgatgactatttctacaacttcccatcaggatgacagcggaaataccgtagaatataccgatgacgagaaaaagcagctgaaggagaccgcaaacaaaatcgaagatgcggtaaagaatggaaaaactctcgaagatgctgcaaaggatgaggatcagcggaccactaccggtgcgtatgcatccgatgattccacattggatacatctgtgaaaaaggcattggatgatttgaaagaaggagaaacttccgatgtgattgaaacagacagtgcattatatattgttcgtctggacagtgaaacagacaaagacgctacagaaaaaaatcgtcagaatattattgacaaacgtaaaagtgaccactacaatgaagtgctggagggctggcagaaaaaagacggctggaaggtcaataaaaagaatgttgcaaagatttcatttaagaattccctgacacagcaggacccgaatgcctctacagagacacagacttccacagaaacacagaatgcagagagtacacagtaatgcaaaaagataacattgtgttaattggaatgccgggggtgggtaagagcaccgtcggcgttatccttgctaaggtgctgggatatcagtttatagatgcagatttagtcattcaggagcaggagaagcgcctgcttcgtgagatcattgcagaagagggaaccgaagggttcattcaggtagaaaaccgtgtgaatgcgacacttgaggcacatcatgcaattattgcaaccggaggcagcgtcgtctacggaaaagaagctatggagcatctgcaggaaatcggaacggttatatatcttgaggtggcatatccggagctggaaaagcgtctggaagatatcaaaggcaggggtgttgttttaagagacggacagacgttatatgatctgtatctggagcgcacgccgctgtatgaaaaatatgcggatatccggatttcggagacggggctggatatcgaacagaccgttgaacagattgtggatggtatcacaaatttacactagatgaataggatagatagtagggtagcgtactatacgaaatagggcgtttattgaggtgagatatggaacaatatgtaatcaaaggcggaaatccgctgaatggtgaggtagaaatcggcggggcaaagaatgcggcactggcaattcttgcagctgcgatcatgacggatgaaacggttacaatcgaaaatttgccgaacgtgagagatattaatgtattattgcaggcgattgcagagatcggtgcaatggtagaccgtattgatgcacataccgtaaagatcaacggttcatttatcaaagacgtgacggtggacaatgaatttatccgtagaatccgtgcgtcctattatttgatcggtgcacttcttggaaaatacaaaaaggcggaagtggctcttccgggcggatgcgatatcggaagcagaccgattgatctgcatatcaaaggatttcgtgcaatgggagcagaagtggatattgcacatggtcttgttattgcagaggcagaaaaattaaacggaacacatatttatctggataaagtatcggttggagcaacgatcaatattatgatggcagcatccatggcagaaggaaaaaccgtaattgaaaatgcggcaaaagagcctcatgtggtagacgtggcaaatttcttaaacagtatgggtgcgaatatccgtggtgcaggaacggatgtcatccgtattgttggtgtggagaagctgcataagacagagtattcggttatcccggatcagatagaggcaggaacctttatgtttgcggcagcggcagcagggggagatgtgctggtaaaggatgttattccgaaacatctggaagcaacaaccgccaaacttgtggaggcaggatgcaaagttgaggagttcgatgatgcggttcggattatttcggatgggaaactgcatcacacacaggtgacaacacttccgtatccgggattcccgacagatatgcagccacagatggcagtaattctgggaattgcagagggaaccagtacagttacggagagcatttttgaaaaccgtttcaaatatgtggatgaactgacgcgtatgggagccaatatcaaggtagagagcaatattgccattatcaatggagtgacccgttatacaggtgccagggtgaatgcgccggatctgcgtgcgggagcagcgctggtgattgccggtctggtggcagagggaattacggtgattgatgatatttattttatcgagcgtggatacgaagaatttgatcagaagctgcgcggcattggggcacagattgaaaaggtatcggatgaaaaagaaattcagaagtttattctgaaagtttcataaataaaaagaacgggtaaaaaagggagtgtgaaaaacattggtatgttttcacactcccttttcatttgaaaaatttataaaaccgctttgatatagaggtcgcggctggcggtggaaagatccagacaggatttatcatcaaactggacaatcggacgggacagtgcattctgatttaacatgacaatggtacatccccttccgtcacttaagatgacgcggttactctggtaagtgctggcaatctgctttaagaaaaccagaatatattttgtatggtatttctggaaaccatcttcttcaaatttactgatcacttcgaacggacacaacggagagcgataggaacgtgccgctgtcatggcatcgtacacatcggcaattgcaacgatcattgcaaaattgtcaatgtaatcttccgtcaatccggtcggatagccgcttccatcacagcgctcgtgatgcatcagggcagcttttttgatacgggaatccagatccggctgacgttttaaaatctcgtatccgagtgccgggtgctgtttgatttttgcaaactcctcatcggtcagagatcccggcttatttaaaatatcggaaggaatcagcagttttccgatatcgtgcatcagtccggcaagcgtaagaatgtccagatcgtgacgttcaaaacgcagccagcggccgatcattcgtgaaatgagtgcaacgttgagactgtgcgcataaaccgaatcggccacagtacgcatgttgtaaagcatatcaaacatttcaacgatggtgttgcgggactggaacagatctgcgacactgcccagaagtttttgcgagtcaatcggtttgttatccttgatggctgcggtatacaactgtttcatcagctcaattgcctgaacatactcaatctggaacgtgcggaattcactggaaccggcgactttctgtgagtgtgttttgctttcctgtgcgtatgtttttgcttcttttacaggctttggagcctcctcctgcggagcaggttcttcgccctcaatttctgcatattccacacggtacagtttcatgcggttgatcagctgacgggttacagcagaaccggcgggagccaacggctgtccaagcggtgtgatcacaggctgtgcaaggatggcaccttcttgtagttgttttgtctcaatttttatcatattttatctctccgtatgtaacgtatatacaaaagtatagaattatttcgcacaaaagtcaatcttttagggcttgacagatgaaagaaactggagtatggtagcacttggatatttcaaatttaatattgtaagctttctcttattcagagtgatggagatacataggatctgtgaagtcacggcaacccctgttttggaaggtgccaacctgagcgagttaatcgaacaataaggggatttgattatctttagatcaatccgctgcgaggcggttttttttatttctgtataaaacaagagaggagaaacaaaaagcaatggaaaaattattattcacatcagagtccgttacagaaggacatcctgacaaaatgtgtgatgcgatttcagatgccattctggatgcatgcatggagcaggatccgatgagccgtgtagcctgtgaggcagcaagctgtaccggtttcgtacttgttacaggagaaattacaacaaaggcaactcttgatattcctgcaattgtaagaaagactgtaaacgagatcggatacaacgatgcaaagaccggttttgacggacatacctgtgcggttatggtagctttagatcagcagtccgcagatattgccatgggtgttgacaaggcacttgaggcaaaagagggcgagctgacagatgatctggataccggcgccggagatcagggaatgatgtttggatatgcaaccaatgagacaccggaatttatgccatatccgatttcactggcacacaagctggcattacagcttacaaaggttcgtaaagacggaacacttacctaccttcgtccggatggaaagacacaggtttctgtagagtatgatgaagcaggaaagccaaagagacttgaggcagttgttttatctacccagcatgatgaggacgttacccaggaacagatccatgaggatattaagaaatatgtctttgatccgatccttccaaaggagctgatcgatggagataccaaattctttatcaatccgaccggacgtttcgtaatcggcggaccacacggagatgcaggtctgaccggtcgtaagatcatcgttgatacctatggtggatatgcacgtcacggcggcggagctttttccggaaaagactgcacaaaggttgaccgttccgcagcatatgctgcacgttatgttgcaaagaacattgttgcagcaggtcttgctgataagtgtgagattcagttatcttacgccatcggtgttgcacagcctacttctgtcatggttgatacattcggtacaggaaagatcgcagatgatgagctggtaaagattgtacgtgagaactttgatcttcgtccggcaggaattatcaagatgctggatctgcgccgtccgatttaccgtcagacagctgcttatggtcacttcggacgcaatgacttaaatctcccatgggaggcaacaaacaaggcagaggctttaaagaagtacctttaatttatgaaaagtttacataattttttataaaagaatgatataataagacacagagtttgttctgtgtcttattttttttacagggaaggaatacgaatgaagataaaaaccaaactgatcatttcgttctgtattattatctttgtgccatcgatcctggcgattgccacgatcagcgcctattgtaattttcagtcgcatgtgatcgagcagacgtatggaattaagaatgcggatgcctatagtattatcaattctgtaccgatgttaaaccgttatactgcaccggattttgaaaagatcaaaaagaccataaagttatctccttcaaaaatggaggacgtttcgtatcttagtgagatcaatgagagcctggaacagaaatattcctatctggtggtaagaatcggggagaatatttctttcaatgggggaagtgataatgaaaagattctttcggaacttccggtatatggggcaaacagttcgaaacagggagtggacaaatatatcgaccgggacgatgaaattctggtaaaacaggtagatttcaagctggattcgggagaaaaatgtacggcatatattgtcacgtcctttgacgctaccgggcaggaaatccgccagtttattgtatggggaatcatctgcgtggtaatcattctgttgctgacggcgatcatgatgattgtgtggatctaccggagcatgattacaccgatccagaaactgcgcgttgcggcagaaaatatcaaagaaggaaatctcgattttgcgttggataccggaggcgacgatgagatcggggaactttgcacgacctttgaacagatgcgtcagcgcttaaaagataatgcagaggaaaaactaagcaacgaaaaagaaaaccgcacgctgatcagcaacattgcccatgacctgaaaacaccgattacggcggtaaagggctattcggaaggcatcatggatggagtagccaatacgccggagaaattagataagtatatccgtaccatttacaacaaagcaaatgagatggatacactgatcaatgaactgacactgtattccaagatcgacaccaaccgtattccatatgattttgcaaagctgaacgttgccgcatattttaaggattgtgtggaagaaatcggactggatctggaggcaaaggggattgccctgtcctattttaattatgcaacaccggatacccagattattgcagatccggagcagctgcgcagagtaatcaataatattataggaaattccgtaaaatatatgaataaaacggaaaaattcatcaacatccggattaaggatgtcggggattttattcaggtagaaatcgaagacaatggaaggggaatcgcccagaaagatctgccatatatttttgaccggttctaccggacagatgcttcgagaaattcggcaaccggtggcagcggaatcggactttccattgtaaaaaagatcatagaggatcatggagggaaaatctgggcaaccagcaaagaagattccggcactaccatgtactttgtaatacgcaaatatcaggaggtaacagcaaatgagcagaatactgatcgttgaagatgaagtggctattgcagatctggagaaagattatctggaactgagtggctttgaagtggaaattgaaaatgacggaaccaaaggactcgaaagagccctgcatgaggagtttgatctgtttatcttagatctcatgcttccgggagtagatggatttgaaatctgtaaaaagatccgtgagataaagaatacaccaatccttatggtttctgcaaaaaaggatgatattgacaagattcgcgggctcggactgggggcagacgattatgtgacaaaaccgttttccccgagtgaactggtagctcgtgtgaaggcacatctggcacggtatgagcgactgatcggcagcaatatgccacagaatgatatcattgagatccggggcattaaaatagacaagacggcgcgccgggtatgggtcaatggagaagagaaacagtttacgacaaaagagtttgatttgctgacttttttggcagagaatccaaatcatgtatttacaaaagaggaattgttccgtaaaatatgggatatggaatctatcggtgatattgcaacggttaccgtacacatcaaaaagattcgagagaagattgagatgaatacgaacaagccgcagtacatcgagaccatctggggagtcggatatcggtttaaattataaacggtctgcctcctgaaactatgattaagggggctgttatgaacgaacacaaaaaacatggcagcagtttctccagcaaaatgggctttattcttgccgctgcgggatctgctgtcggacttggaaatctgtggaggtttccttaccttgccgcaaaatacggtggaggttcttttttactgatctatgtgatccttgcggttacgtttggatttgcacttatgatcacagaaattgcactgggcagaaagaccgggaaaagtgcactgtatgcattcagcacgctgcatgaaaagtgcggtttcattggaattcttgccagtattgtgccgattatcattcttccgtattattgtgtgatcggtggatgggtcatcaaatttgcatgggcatttcttacaggaagcggaaatgcagcggcagcagatgattatttttcaaattttattgcaaggactggggaaccggtgatgtggctggtattttttatccttgccacttcggttgtgattctgcttggcgtaaataaaggaattgaaaatatcagcaaagtgctgatgccgcttctggtagtcctttccgttattattgcggtatttgttgtgacccgtccgggagcaggggcaggaattgtctactacttaaagccggatctttccaagatcagtgcgaatgctttcctggcggcactgggacagctgttttattccatgtcgctggcgatgggcattatgattacatatggctcctatatgaagaaaaatgaggatatagagagcagtgtgcggaatatcgaaatctttgataccggaattgcatttctggcaggactgatgattgtaccggccgtgtttgtgttttccggtggagatcaggcatcgctgaaggcaggaccgacactgatgtttattacactgccaaaagtgtttgacagtatggcgggaggacacctgatcggaacggtattttttgtgctggtattgtttgctgcactgacatcgtccatttccctgatggagacagtggtttccattttcgtggataagacaaaaaagagccgtaaatttattacggtctgtgtaaccgtttatacggtgttgatggcaattccgtcttctcttggatttggaatctggagcggtttttcgattcacggaatgagtattctggatttcttcgattttatatccaacagtgtccttatgccgattgtggcattcctgacctgtgtatttgtcggttttattgtgaaaccagagacgattacggatgaagtggaatcttccacacagaaatttaagagtaagaaactgtatattgtattgatcaagtatgttgcaccgatactggtactgttgattttattcagttcggtattaaatgcacttggaatcattactttgtaatggacaacagaaaagaagaaacaaaaaaccctatgcattatgcatagggtttttagataaatatatgtttgttctgttcaattgtattcggacttgctaggcagttccggagtttaacctctccggcaggggtgtgagcacacgacggataccggaaccctccgcaggaattcctgatccaaatagtccgcatctgctgtactgcgttttcaacaggcagcatgtcatgttgtgaaaacaaatccctgcgctggacaatcgcgcttgctgtaaaaaacagatcaatgaaatctatgacatactgagctgtaatactgacagttcagagaataaaacctacttgtttatgcgtgcggtactctcaccgcctgagcctgatggtcaaatattgtaccgtccttatatggactcatataagcgtaccccgaaaaccgaagtttgtcaagtgttattcgcttttcatgaccattatacgctatgtttgccgggaaatcaattgtggaaatccgagaaatacaaaaagttgtgtcaaaagagggaaaaacggctcaaagattgcaagaaaatggtcgatatagtataataaggtataaaaaagtaaaggcaaggaaaaccatgatcgatattcactgtcaccttctgtacggagtagacgacggagcaaaaacaatagaagaatctgtggcgatgcttgaggcagcaaaagagcagggcatttctgcaatgatcctgacaccgcattaccggcacggcatgtttgcttatccgaaggaagaaattgaagaacatttccgtattctggagccgtatgcacagaaacttggaatttatcttgcactgggcaccgaataccatgtgaacagtcatattgtcgaggcacttgacagtggcagatgccggacaatggccggctcgcggtatgtgttgtgtgagtattcgcacgacagtgaatatgcctatatttaccagatgacgcaggaactggttttgcacggatatattccggtatttgcacatgtggaacggtatggagcacttgcggatttgcagctggcagaggagctgcgcaatcttggggcatggattacggtgaatgcggatgcggtgctcggacttgagggtatgggtccaaagaaatactgtaaaaagatgctgaaggcagaatgtgtggatgcgattgcatcggacagtcatggaataaaaaaccgtgccaatcatatgggaaaatgctatgagctgattgaaaaaaaatttggcagggaatatgcggatcagcttttggtgaatcatccggcaaagattctgaccggagaaatgaaatagttagtaatggagcattgatatggagcagcagttacaacaggaacgtattgtaattgaaaacgatgatgaaattgaaattgatctgaaagatctcgttttagagatcctttctttctggaaatgggtgttgtttgcactgattatcggagccgtgaccgcatattgtatcagcaggtttgtaatggtgccgcaatatgagtcaacatcccagttttatgtattgtccaaaagcatgtcgattacaagtcttgcggatatacagacaggtacaagtctgacaaacgattatatggttatcgtagaggggcgtcccgtgcttgagcaggtaattgagaatctcggactggacgagacctacagttccctgaagaaaaaagttaccctgaataatccttccaactcgcgaatcctcgagattacggtgcgcgatgcaaacccatccatggcaaaaaagattgcggatgagattgcgcgtgtcagtgtggcctttatccaacagaaaatggatcaggatgcaccgaatatcattcaaaagggatattccgacggagaaccggtcagcccgaatatcatgaaaaatacggcggtcggaggaatacttggcatgtttttggcgattgcggttattgtggtggcttatctgttcaatgatacgattatgaatgcagatgatgtacaaaggaagctggggctgaatgttcttggtacgcttcctttggaagaagccgaatacgatggggaaaaagagcgcaagcgtaagagaaggaagaaaaagaaatgaaatcggtaacatttgagaatctgaaaaaacaaaattatacgatgaaagaatcactccgggcattaaaaaccaatatccagttctgcggagatgatatctgcaccatcgttgtgacatctgccatgccaaacgaagggaaaagtaccgtgacgatggatctggcacgttctttttcggaatccggcaaacgtgtattgctgatcgataccgatatgcgtaaatccgtatacgtgggacgattacgggcagtggcttcggatggaagagaaatctacggattatcccattttctgtccggacagaaaaaactcgaagacgtactttacggtacaacgattccgggcctgtttatgatttttgccggtccgtcagtaccaaacccgacagaaattctggaaaaaaagtattttaccgagttacttaattttgcaaaagaacattttgattatgtattgcttgactgtgcaccgatcggagccgcaatcgacgcagcggtgattgcgaaacactgtgatggtgcgattcttgttattgcccagggcatggcaagcggacgtctgatccagactgtcaaaaagcagatggaagcttccggagtgagggtacttggtgcggtactgaacaaagtacggatgaagaagagcggctatgagggtggctactatggcggctattatggcagctattatggaaattacggagaacatcatgagaagaatgcatgaaccatcgacaaaacttcataatgcattgtattttatgtccggaatgatggtggtgattcttgcacttgtgattgtggcaggggtcaaaacgaaggcggaaaatgccggcttccacattgcagaagatacggaaaattcttatgagcagcaggttgcggggcagacagataccacacaggattccggtcaggaaaagtggcaggagggtgtagttgcttatcagggaaaagagtatctgtataatacagatatcaaaacctacctcatgatgggggttgatatcgatggcccggtacagcagagcagcgattatacccaaggtgggcagtccgatgcactgtttcttcttgttgtaaacaacaaaacagagcagctgcaggttatttccatcaatcgaaacacgatggcagatatcgaattgtgtgatgaagaaggtattgatatgggaccgcttaaaactcagatctgtctgcagcatgcattcggggacggtaagcgcctcagttgcagcaaaaccgtggatgcggtttccggcctgtttcaaaatattccgatcagcggttatcttgcgatgaatatggggggaatcccacagatgaatgatgctgtgggaggagtggaagtgactgtacagcaggatatttcgtttccaaaagccggtgtgaatttgaagaaagggcaaaaagtaaccctgaatgggacgcaggcttattattacctgcatggaagggataccgaagaatatgacagtgcaacaaagcgtctgcagcgcgaagaacagtatattgttgcctatatggataaattaaaaaaagtatccacagaaaacccggatcaggtgacagaaatttacaattctgtttccgattatctggtaaccagtgtggatttcacaagtatgattgagcagctgatgaattacggtttttcagaagaccagatgtatacggttcccggaaaaacggtggagggaaagccgattgacgggaaacggtatgaggagtaccatgttgatgaagatgccatggaagaactcattatgaaggtgttttatacacccgtacaataaggtatccagtgcgcgcgcacttgatatagatagagttacatgcagtttatattacgtggaaaggaggtagattgcgatgaaaaagaaaattttcacaggagttgtgacagctatgatgctggtatttacaatgggcacaaccgtgtttgcagatccatcaccaacaagtgatacggcactggttcaaagaaccaatgagctgaataaggcaacaaccgttgaaagcagcggttataatgcaaacaatgagcttatcacggtttcttccaagggtgtggacaaagatgtttaccgcgagggaaaccgtcaggcaaatgctgtggcaagtgcacagaacggaagtgcaaccgtcatggccatgtctgatatcagtgttccgtctgcaacgaatacatccaaaggaatcaaagtaacgatttgtgcaagtggaattaaggctggagacaatgtttatgtattacataaattaaaaagcggaagctggcagacggtaaagccggacagcgtttccaatggcaaagtcacggttacattgtattcattttcaccggttatagttgtaaggtacagttcaaatgtgaatcctaccgttacaacagatccgtcaaaggatgaaaattcccagggatcaaatacaaattccaatgtaaatgacaattccaacagcagcagccagacaaacaacaacaaccagaacaactcacagaccaataatcagtacaatccggttagtgtaaatcagaatgtgacagtaaactatccacagtcttatgacgatggagaggacagtttcgaggatgattatgacgacggttatacagatggttataccgatggaaagaattccgtacggaatacttccacaaagagttcttctgcccgtgtcaatggcaaaagtggagcaggaagtcagaaaggaacatcagcttccggatctgtttcctataagacatctccaaaaaccggggcagcgcttccggcacttccgttcgttgcagtatttgcggcagcaggtattgttgtatgcggaagaaaagcacgtaagaattaatctcactggatacaattttatttagcatgtaggtctatggatcggtgatgcatggcatcacgtgagggcggtggaatggaatctgccgccctgcctcaattttaaagaaagaaaactattttatgaaaagacaggaaagaaagaacgacagaacgatcaatatctataaaattctgaccattgttctggcagttgtattgatcgtggtactcataatatttggaagaagctggatggttcagaagaatgcacagaaagaatatgaaaagctttctgcccaggtaaatgatctgcagaatcaggtgaatgataatcagatccatattccgtcagatacgcagactgagacggagaatgtggcacgggaagtgcagaccgaagacagcgaactggaacaaaaaggaatagaaattccacagaaaaatttaaactggaaaaaattaaagggagtcaatcaggatatttacgcatggatctacattccgggaaccggggtggattatccggtgttacagcatccgagtgatgattcctattatctgaaatacaatatgaatggtaccaggggatatcctggatgtatttatacagagaaggcaaacagtaaagagtttacggattttgataccgtcgtgtatgggcacaatatgcgtaatgacacaatgtttgcttctctccacaactatgaagaccagacattttttaacaattttccgtatatatatgtgtatacaaaggaaaaggtgctcgtgtatgagatttttgcggcatataagacggacgatgcacatattctgcacaccaatgacttttcaacgaaagagggacgtgtaagttatcttgaaagcattgtgaaaaaatccaagaattcgccggaggtaaaggaaaaaatccagctttcggtggacagtcatctgctgactttatcaacctgtgtgagcaaagaggcagataagcggtttgtggttcaggcaattttattaaatgaggaacagctatgaaacagtgcaaagtaggtatggatcaggaaaatatcatatcgacctttgcaagtacgcagttttacggagatccggatgcttatatccgggagtttcttcaaaatgccattgatgcatgcaataccagggcggcgctggaatggagctggggaacagagtttctggagatggaggaggcaagagccttaaattccatgcgaaatccgtattctcctcaaatttccattcagtataattccgaaacgcagcgtctggtgtttgaggataacggaatcggaatcaatgccagggatattgagcagtatgttgccaaaatcggcgtgagtttttatcagagcgaggatttttccgcacagcagcttcattatgaaccggtggcgcagtttggagtcggtatgctttccggatttatggttgcacgggcactgttgattgagtcgagaaaggacaaatcggtaaataccgcgtggaatgttacggatcgccagtcgttagagccggttaccgcaaaatggattgaaggggcggaaacgatggaatatatcaattccaaccgggaacagtccggaaccagaattacgctggtgttacggccgaaatatgcaaagaatctgtcccttcagaggctggtgcacgcagtacagcactatatgctgtatcagccatttcccattcagatttcctttgatgaaaaaagcgtgacgctgcgagaacagaatcatatcatggacaatccgttcgcggatattcttggaatcatatcgattcgtatcatggatgaactgatggaggggtgtatctggatttataattccaaacatcagggactgatcgggacatcctgcctgtatcagcaggggtttcttgtgaccgatgaaaagaaagatctggggttaaaaccggagtggctcaggtatatgacgtatcatctgcatttacggaaaaaattcctgactttgcgtctggcaagggatgatgtggcgcatgatgaaaatctgacggagctgcgcaggctgatcggcagacggattgtagaacattttgcatccaatccgctggggctgaaccagtatattgccagcggacagcagccggttctgacagagtatgaagaagagatgcagctgcttggcaaagctgtcacagtggaagtttatttaaaagggagagagattgaacttccggttgcaacaattattcagggttataccggaaaaagcataaggattgcatttatcagcaaggggctgtttacatattacaggcagaaccatattatggatttccggcgttttctggcagaataccagctgattgtattcgaaaagaaccgggatctgttctgccagcttctggcgccttatcagggtagcatgcactatgtgataagcagtgaatgtccgggtgttatatatgaagaaatggatgcagatttccatatgataaaaagtgtggtaccatatcgttatcagtatcatctgcggccggaaacgtttccggataacgagattttctgtatggtgacgaatacggcaaacggaacgctggaactgcgtgtcaatccaaagcaccgactcttaaggattcttgagcctgtgatgtatcatccgaaagttcaccggatgatggaggtcatctatgagaatatcaagcagcgggttatcaatacgcagcatcgttggaataagattgttgatttcggcggttcgttcgtagatgattggaaaaatcaggagaatgtgccgacagtgagctgtatctggtgcctggaaggcgattttgatgtatctgtgaatgaatttattgcacagacactgacacagaaagaacgtgtcgatctgggacttgtgggactggttttccgcaggcaagattttattgactggtggtttgcaccaagagagtagggtgattatggaagaaaaaaaagaaatattgacagaagaaataaagatggataatgatccaaagggtgagggaaaggagaaagccacttcgcctctgcgcgaagtgctcagctgggtgatcactctgttggcggccttcgcactggcaatggttttgaagaattacgtgatcatcaatgcaacagtcccgaccggatcgatggagcataccattgaaccgggcgatgacctgttcgggctgcggctggcgtatcagttttcagaaccgaagagaggagatatcgtgattttccggttcccggatgacgaaacgcaaaaatacgtcaagcgtgtgattggtctgcccggagaaaaggttaccattgaggatgcaaaaatttatatcaatgactctgagactcctttgaaggaggattacctgaaagagacatggacagaggcaaccggaccgtttgagtttgaggttcccaaagacagttatctggtgcttggagacaaccggaatgattcctatgatgccagatattgggatcatacctatgtcagcaaagataaaattatcggaaaagcttatttcatatactacccattccaaagactgggcagtctatataaataaatcattaaataattaacaaggaggctatcattatgccagaaaattcaagttgcagcggagcatcatcctgttccaaagcaagctgtgagggatgttcccataattctcagaatccgcagagtatgctcgaagcgatgaatgcatattccaatatcaaacatgtgattggagtggtcagcggaaagggaggtgtcggtaaatcatttgttacttcttccctggcggtacagatggcgaaagccggatataaagtaggaattctggatgccgatattaccggaccgtccattccaaagatgtttggagcacacggtcagctggtcggtgacgaaaaaggaatgtatccgtatgagacaaaagaaggaatcaaaatcgtttccatcaatcttctgatggaagatgaagaggcaccggttgtctggagaggacctgtgattgcaggggctgtgaaacagttctggaatgaggctgtctggggcgatgtggactatctgtttgtggacatgccaccgggaacaggtgatgtaccgcttaccgtgttccagtcccttccggtggatggtatcgttattgttacatctccacaggaactggtgcagatgatcgtaaagaaagctttccatatggcaaatatgatgcatataccggtacttggactggtggaaaatttcagttatctgaaatgcccggattgtggaaagaagatcgcactgtttggagaaagcaacattgacgaagttgccgcaaaagaaggaacccgagttttaggcaaactgccattggatccggcatatgcgaaagctgcggatgccggtgcattctatgagatggaaaatccgtatctggatgccgctgtggatgcgctaaagacaatttaagacaagaaaaaacctgtcagtgatttttcactggcaggtctttttttatttctggctttctaaaaccgcagattcggtattgttgttgtccgattctgttcctgtaacggtttcttccacggcaggatctttgtaggtgtacgtgttggattcacggaaaatcgtactgttggaacccatctggcacactttaatggtatcaccgtctttgacactgtcttttggaataatcagacaaccggaattgctgaaggttgtattgactttctcatcgtttacaaacactttactccacttggtgaagttgtttccatagacaaacacttccgatccgccgatggaatccgacgtctccgataccgttacatcgtcaattcccattacaatgtcggttgcagggtatttgtctttgccatcatagcagtaacggtttccgtaaagaatgtcatactgcagattatccagtccgtccagatatgcagtgtggtctgtgttgttcatctgggtctgatggtaatttaagatagttccctcatgaatacctgtggaatccgtaatgcttgccatcagctgatatgcatacagatctgcatccggcttctttaatcccatattattccatgtgacatattttgtcttgtagatatcaccggatttcatatcggagtcttccagacccatggttggaagatgatcgccgaacgctaccacgatggtatcttcatctctcttggagagctctgtaatcagatcattcaggaaagtatctacttcatttaactggttgatgtaataagtccactggtttttcttttcttcatcatccacaccgctgacggtatataccggatttgcgataaccggagtctttggataatcaccatgtgtacctacggtaatggtgtaggtaaagtccggctgattcggagtggaatctaaggttttgattgtttcaggaacaagaatatcatcggtagcccagcttccgtttggcgtataactctgaatgttcatcagttccttgctggtgaaagtatcaaatcccatcatggaaaaggcattgacacggctgtaaaagttaccgccattgttatgtacggcatgggttccatatccgatggaagccagatcagcagcagtgctctcgcagtctgtctttttcaggattgttttatacggatactcgccggttccgaagtactgcatactcataccggagagaacttcaaactcagtgtttgcggttcctgcgccaacaaccggaactgtcaggtaaccactcgtgtagttcttctcgagattgtggaaggtaggaatcggatcctgattataattcagaaacttgatctcatccggatcacagaatgattcaagaagaatacagataatatttggtgcattctttttggtgacagttgtttctttttttgtgtcatttacatttttttcaatcgaagcaattttctgctcggagtagtcatccggcttgctcattccacggtctaccacactcgaagagaatccatagataaaaccgtagttttcatatccctgtgcaatgttggagaagtaacttgcaacaacattggcattctgtgcagcagaggttgtaacaggaagaccgacaaacagtaccgatacaatggcacctactacaacaattttatgggtcttgccctgatagcgcggtcctttaatgaagagcgcaacacaaaacagaaggaacagacaaagcccgatgactacgatagtggcctcttctgccgtaaaatagttggtattgttcatggcaaacagatcattgatacatttaaggtctgtaaagccaaacggtgttacacggtttgaaaggatgcatccgttaatgattccaaggagcacccagaaaccgctgataatgatccgccagaatgcacgtctgcggaacagataaacaaagcttaaggatgcaaatacaataaaggcattataaaaaaatgcaccggtatgcatcccaacgaaggaacatgccgagagaaaactccttcgggaaagaacctccaccataaatacgatcccacaggatatcaacatgtggaacagcagggaatatttattcagaaatgagatccgacgcaggtaagcttcggaatgttgtttttcaactctggtgaatagtttttctttgataatactaaaaaatttcttcatctttacctctcctttactcgaactatagattactaaaaaaggatagtaaagacaagaggtaaaatttataaaaaaaccccgttaaaaacgaggtttttttgcaatatgaataaattgtgaacaaacggtgttcttatcggttggaacgtctccagatgtgcatctggtctgcctctttgatcagatcatcacggaagtccggatgtgcaatggaaatcagagcctctgccttctgccaggtagataatccctttacattgaccatgccatattcggtaacgacatagtgggtatttgcacgggtgtctgtgacaatagaaccttctgccagggtcgggcggatgcgggaatgcataacacctttcttatccgtgaatgtggaagaacagcagataaagctctttccacctttggacatataagcaccgagaacgaagtcaagctgtccgccggcaccactgatgtgtttggttccggaagactcggcactgatctgtccgaacaggtcgatatctacacagttgttgatggagatgaagttgtccagtgctgcgatggagcggatatcgttggtgtaactgacaggtgcgctcatcagttctggattttcatccagataatcatacatcttcttggttccggcaccgaaaccatatacctgacggtagcggtcaatgtttttgcaggcaccggtaatctttccggctttggcaatgtctacgaatgcatctacatacatttctgtgtgaacaccaagatcctttaagtcggactgtgcgatcagggaaccgactgcgtttggcataccaccgataccaagctgcaagcaggcaccgtttggaatctggtctacgatcagctgtgcaactttctggtctacttcggtagcaggaccgccggcaccgagttctccgattggaggattggagccttctacgattgcattgactttggaaatatgtataccgttttctgttccgccaaggcagcgcggcatattttcgttgacttctacgatgatatgtctggctgtctcacacatcgcaccaagatgggaagcacttggtccgaagttgaagtatccatgcttgtccattggagcaacctggaacattgccacatcatccggacaatccagctcacggtaataacgagggagctcggaataacggatcgggctgtagaatgcacagccacgtgcgatcatatgacgttcgattccggacatatgccaggaattccatgtaaaatgctcgccggcgtcttcgcgctcaaatacggcaagcggttttaagaggattccgccacgcaggttgatatccttcagttcatcggtacgcttggcaagtgctttgtccagtgcatctacggtgttggtacaccagccatagtctacccagtcaccggatttgattacttttacggcttcgtctgctgaaacgagcttctgtctgtattcttctgaaaaatccattcgtataagacctccttgtatgtcttagcgtgaagttgtgaacagaaatacaacaacttcgttaatttattaacaacattataacatttatggatttcaaaaacaatggggagtgctggaaaacgtaattattctgtggtacacttaaattacatgataaagctttgaaaaaaggtttttgagctatcctacgtttttgaaaatatgacaatagaaaattcattatagagaagaaagagagaaaagatggagaatcatacaattgttactttaaaaaagggagaaggccgcacgatcaaggcgggtggcgcatggatttttgataatgagattgatacgattgtggggacatttaccaatggagatgtggtgacggtacatgattttgacggatatccgatgggaaagggatttatcaatcagaattcgaagatccgtatccgcatgctgacccgtcatgcggatcaggagattaacgagaattttcttcgtatgcgtgtaaagaatgcctgggaataccggaagacaacggtggatacatcttcctgtcgtgtgattttcggggaagcggattttttgccgggactggtggttgacaagtatgaggatgtgctggtggtggaatgtctggcactcggtatggagcagttcaaggaaacaatcgtttcattattaaaaggggtactgaaagaggacggtatttctatccgtggagtctatgagagaagtgacgccaatgagcgcaggaaagaaggacttccgaaggtgaaaggatttattggggaaacatttgatacagaggtggagattacggaaaatggcgtgcactatctggtcgatgtggtaaatggccagaagacgggctttttcctggaccagaagtataaccggctggcaatgcagcggatctgtaaaggaaagagagttttggactgttttacacatatgggaacgtttgcactgaatgcaggaatcgcaggtgcttccgatgtgacgggacttgatatttcggaatatgcggtgcagcaggcaaatgccaatgccgtgcgtaatcatctggaagatacggtacattttcgctgtgcaaatgtactggacgagcttccgaaactggcagaagccggagaaaagtatgatgtagtcattctcgacccgccggcatttacgaaatcccgtgaggccacgaagaatgccatcaaaggttatcgggagatcaatatgaaagggttaaagctggtaaaagacggcggatacctggcaacctgttcctgttcccattttatgacacaggaactgctggcaaagacggtgaaggaagctgcaaaggcggcacacaaacggctgcgtcaggtggaattccgtacgcaggcaccggatcatccgattttgtgggcaaattctgcgaatgtgccggagagctattatcttaaattttttatttttcaggtggtggatgagaaataatccgaagaatgcttatttataggggttccggaacaattctctgatatgaaataaaagactgacacaccttttgacacacttttatagaaaaatatctcgaaataagcaaatcctcttagttcatttgcgcccttgttggattgtgctacacgattttcaagggaaaacgaaaatagccgccattactgcgaataatgacggctgttgataaaacagttacttaatatattcgggtaaaccgcttctctggctttccctttttctacgcataatataacatatcttatgagttgatgcaaggaaaagtgtaaaacggttcataatttataacatgtcatgttttcagatcagtgatgacttatttcggttataataaaaggagaaagctctcgattgactaaccgggtataaactccatataatagtggtaaccgaatggaggagctatagaaggagggagcattatgcaggcattatcaaaagcaaaagttggtgaaaattataccattcagtggttattcggattaccggaagttgtagaattcctgcaccgccatcatgtagaagaaggtggcagcgtacaggtgattcagaaattatccaatgggctgatcatcggtgccaatggagaacggttcgccatgggaaatgagattgcagatcgtattcaggtataagtacacccggctatagaaaacagacaccccggtatccgttataaaaacggctgccggggtgttttgggtaaaaaaatgaaaagggcagtatacttgcattttagagagcattatggcatagttgagaaagaaaatcgaaagcgaaggatgaaaagaggaaaaatgaagtttcgaaaagctaagcaggacgataaggaagaaattcttgcgctgtatcagtcgctgatcggtactccatactgcgcatggggcaatgggtatccaggagaacaggaatttgattatgatatgaaaagaaatgctcttttttgtatggaaaatgaagatggagaaatcattggcacgatcacagtggatgaagatccgcaggtggaagcactcacctgctggtccaaaacactgcagccgtctgcggagctttccagactcggggtacgcaccgatatgcagaatcagggaattgcccggcagcttctgcagcatggcatggaagaattgaaaaaacaggggaaaaggagtgtacattttctcgtgtgtaagacaaataaaaaagcgctccgttcttatgaaaaactgcattttgacgtagtgggagagagcgatttatttgacgaggactggtggtgctacgagaaagaactttaaaaatcaagtacaggaagttggaaaatatgcaaataggacagaaaaaaacaacgggacagaagatgaaaaaagagaggaacaggggaagagaaacggatagaaaaccgaacataagccagatacaaaaaacaggcgaacactgcatttacgcaaaaagatgcggaggatgtgactatcagggaattttgtacagtcagcagctttccaaaaagcagagttacatgcgcaaactcatggaaccgtttggaaagatcaatccaatcatcgggatggacgatccataccactatcggcataaagtacaggcggctttttcctgcaataaacgcggacatattgtggcaggcgtatatgagaaacattcgcatgacatcgtggatgtagagcagtgccagatcgaggatgcacaggcagatgccattatccgtgaaatcaaaaatatgatgcgttctttccggattcgtgcatatgatgaggataccggatatgggctgctgcgtcatgtgctggtgcgaaagggctatcacagcggacagattatggtggtgcttgtactggtatctccgatccttccatccaaaaataattttgtcaaggcactgcggaagaagttcccggagatcagtacagtagtgatcaatgtcaatgaccgcaagaccagcatggtgctcggggagcgcaatattacggtttatggaaaaggatttattgaggatgaactgtgcggatgcacatttcgtatttcaccgacttcattttatcaggtaaatccgcagcagacagaaaaactctaccggaaagccatttcctgtgccaaactgacgggaaaagaaactgtgatcgatgcgtactgcggtacgggcacgatcgggttgattgccagcagccgcgcaaagcatgtgatcggagtggagttaaaccgtgatgcgataaaggatgctatctccaatgcaaagcgcaatcatattcacaatgttactttttataatgaagatgccggacaatttatggtagagatggcagaaaaaggagaacatgcggatgtggtcattatggatccgccgcgtacgggaagcgatgaggcgtttctttcctctgtagtgcgactggctccgaataaagtcgtgtatgtatcctgtggtccggaaacgctggtgcgggatctgaagtatctgacaaagcatggataccggatgaaagagtgtacaccgtttgatctttttccgtttacgaaacatgtggaaacggtatgcttattgtccaaacttcatgaagcgaagcatcatgtgaatgtgaaacttgatatggatgagatggatattacttctgctgagagtaaggctacgtatgaggaaattaagaaatatgtgttggaggagacaggacttaaggtatctaatctgtatattgcgcaggtaaaagataagcatggattggagaagagggagaattataatctttcaaaatcggaggatgcaagacagccaaaatgcccaaaggagaaggaaaaggcgattgaggatgcgttgaggcattttcagatgatattattgcattagcaaatttctagtaaatattacgtaaggagaaaatgatggatataaaaaagacagatgtttttagcggcataggtgtcttcacaatccaaatgattgcgaatggaatatggtatgcttttcaaaaaaataaaatatttttaactattggaataatatttgcagtaattatatctatttttattgtaattattattggtctaagaagaaaactaagggttcaagaagagtatttcgataaacagattgaaaatttaggaattgatagtctgaaaaaagaaaaagatgaactactagaatcaatagcttctttaaataatagaataaatgatgtggaacgtgaaagagatgatataaatcaagaaattgatagcttagagcaagaaatagaattactaaagaataagtgcgaatattacataaatacagcttcagttaatagaaaaatactttattctttaaaaaatagaaagaaatatgaaaatatagaactacaagctctaatcgcagagatagaatatatttttcgggatgatgttttttcaaagaatgcaaaaatgaatacaagtatctttttacaagatgataaaggacagtgtaaaattttagtatcaactaaacattcacctggaacaatagataaattgcgtttagataagggttctttggttgggactgcttttaaggaaaaaagaataatctattgtggggatattgataatagaaaggccgatgtaccatttttagatttagatgatgatagacagtatcaatctatattggctataccattgagtgtagacgatacgacagagtttgtattagtaataacatgtacaaaaataaattgtttacaagaaacattcaataagtatcaagatgttattcagagatacttagaattattatgtattttattatttatatctttcaatcaggaggaattataatgataagaaaagagaattatttagatattttggagagagaaacacctataaacataatacaatatgaagaagaggatatgtttttattacagaaattatattctgattggatgaacttgaatgaaaaaataaagcaaatcggcggaagacctagtagtttgccatcagagtttgtagaagctttagttgcgtataaaatgggatattggagaattgataatatgagtgtcggttttgactgttttgacccaaacgcaccaaaaggaaaaaatcgtattgaaataaaatatgcaacaggacgaatggatttttctagcttttcaccggaaatcaaatgggatagattgaatttcgtgaaattttataatgaatcacctgaagactgctattttgaggtttatgatattgatattcaaatgatatttgaggaatcggagcgctttggaaggtacatatatgatagacggggatgcagaccacgcattagtgttattagggagttgattgaaagaggaatatataatgaaaaaagagagttttctttgttttagatctaaaaaatgaaatatgtttatagcaggagctgatgtgctaagctgttacaaaagcaataggctcaggtttctgtataagaaatctgagcctttgcgcatatatctattaacatatgtagaaaaatggatttaaagagatgtgctgtatacagataaggaaggacaagaatgccaagaatactatacacagaatatcaaaagttctgcagtgcaataagtgcataagaactatcaatgatagtgattaagaaaaggaatagtacatgaaaatctcaagattaatcatgtctactatgaagtttcaatgcgaaagggagtgatatcagtgctacatgttgctatatgtgatgacgaagagaatgaaatagagtatttgaaatatgctgtagaggattgggctaagaaggaagacatcataacaaatatagaaacatatgcatctgctgaaagtttcctgtttcaatacgaagaatgcaaaaattatcagattttgttattagatgtggaaatgagtggaatgtcaggaatcgatttggcaaagaaaatacggcagaatcaggataatgttgagattatttttataacatcacattttgagtttattggcgtagggtatgaagtagatgccctccattatctggtcaaacctgtgaaagcaggtaaaatggaggaagttctttcgaaagcaaaatgcaagatagaagcaggagaaccgtcgattatcattcattacgaaggtgaagttgttaagttatatgagaaggaaatcctttatttggaatcactttcccattatgtaacaatatatacaaagggtaaggaatataagataaaagcaaatatttcaacatttgcacagaaacttagtgaagatttttatcagacacatcgttcgtaccttgtatcattaaagcatattatgcgtatttcgcgcgacagtgttacactggataatgggggacaagtgccacttgcaagaggaaaatatgatcagatcaatcgggcatatattgagcgtaattaggagttattatgagaaagaaaacatatttgaaacttgtccagtatcagacagagcaggcaaaacagcatctaaatgaagtgcgaagtatccattcggaaatgagaggatataaacatgattttcaccatcatctccaagccttaaagggacaattagaagcaggagaggtagaacgtgcaattgcctatatagaggaattagatcatcaattgatgaatgttgatacacttctaaaaacagggaatgtatcccttgatgcgatattgtcagctaagattgcgcaggcaaaagcagagaatatagcagtcgatgtgaaagcaagtgtaccggattcattgactatcacagatgtggaacttagtattttggttggaaatttattggacaatgcaattgaatcctgcaggctttcttctggtaagcgttttattcgtatatatatgtcaatgaaaggaaagatgctgtatttttccatgctcaattctgccgggatgaagaaaaagaaaataggaacattattttcctctaataaagagggaacgcatggatttggccttcatcgggcagagacgattatagaagaacatggtggctggtgcaaatataatagcgaggatggagcatttagctccgaatttttagttcctgcaatggaataactgcaattcgtgtactgacagatacagttggtgcacgaattttacgttgtagggttaaggagatgtagaatagcagagaaggaggtgcattatgctaaaaaatatttggtactgtattaagaaaacatctgaatggtactttgccttattagtgctgtacataatactgacccttgtaaatgctacaatcccaattctgtctgcatttttaccgaagctggtaattgaaaagcttactttaggtagtgatattaagggattgataggcactattatggtatttatgggaagtattgctgtgttgaccggagtcagcaagtttcttacaaaatatctatattttgagaagtttagtattaacgttcattatctgaagcttgtagcaaacaaagggttaactacggactacataaatcaggaaaacggaatatttcgaaagctgcaagaggaaagtttcctgtgctgtaacggacattcacccttaacgcaagtgtatgatgtactacaaagtctcggtaccagtgttttggggatagctgtcttttctgcagttctttataaactaaatgtagctgtaatactatttattgttgtgaccactgcggttagtttctatttaaacaaaagagttgtgaaatggacagacgagcatagcaaagaaagaatgagttatgtacaacggcttaattacattaatgcgatttccggcgacgcgcgttctgcaaaggatatccggctttatcctatggcaaagtggttctccgatatttatacggataatatgaaggggattgcggcatggtatcacaaattgacaaaaaaacttttttctgtgacagcgtgtgacggagcattaggtttattgagagaaggtatcatctatctgtatttgatctatctttttatgaatagtcagatttcggtggcagattttgtactttattttggagttgtcaatggtttttctgcctggttaagtgaaatatttgccgaagtctctgtgttgaatcagttaagtacaaagattaatcgatttcgggaatatcttgacttcccggaagagtatctgagagaaggtggattgcatccaaatcaggataagttgccaaaggtaattgagctaaagaatgtaagttttagatatgaagaaaaccagccatatgtactggaaaattttaatctcgcaattaatccgggtgaacaccttgctgtagttggtttaaacggagcaggaaaaacgactttagtaaagcttatctgtggtctgattgacccaacagaggggcaggtgctttacgatggaaaatcaattgcggaatatgatagagtagaactttaccggatgtattctgcggtatttcagcaatttagtattatgccggtgactgtagaagaaatagttgcagaagcacctgcggcgcaagtggattctgaacgagtgaagaaatgcctggagctggcaggaatgtgggaacgaatccaaaaactaccgaataaattacagagtcaatttggaaggacgatttatgaggacggagtggaattctcgggaggtgaaacgcaaaaacttctacttgcaagggcaatgtacaaatcctcaccgattatgttgttagatgagcctacggcagcgttggatcctatagctgagagtgagatatatcataaatacaatcagattagcgaaggaaaaactacagtatttatttcgcataggcttgcaagtaccaacttttgcaacaggattatcttgattgaagatggtgctatctgtgaagaaggaacgcatagggagcttcttgacaagaaggggaaatattataacttatttgaaatgcaggcaaagtattatcgagaagaggaggtggcagaatgaagaaaatgtcttttggcgaacgaattagaatcaccaaaaggggatttggaattttgagaaaatattgtccgggtctttccgaacaaaaagcattgtatgagttcatacattcactgcaaccttttataacaatttggttttctgcaaggatagtggatgaattgaccaatcattgtaggaaagattatattgcttcctatgtgatatgtgtaattacaattaactttatatgtatcgtatttcaaaatgtacttttgcatatatgtaatgagaaagaatcgcaaatgtggatttggtttgaaaaggttttttcagacaaacagatgtcattagattatgatgacctggaagatgtatcaatacagaaacagcgtcaagaggtggaagaaaatctctttatgtttggaaatggtcttgcacagctggtttggggaacttctgtaatggtgaaggtatttattaatatctttgttgctctattaatgtcaggcactctttttatttctaaaaccggagagagaatcgtggaccatccgatttggattgtagcaattttaggctgtatcactttatgcggatttagtaattataaagcgacaagaaaagaaaatagcctgtttatgaaatggtgtgataatagcttatggtttaataggacatttatgtttttcgggcatgagctatatacaaatcttgagagggcaaaagatgtccgtatctataggcaggatacccttgctattaagaaaatagaagaattagaagcgtggggaaaagctgaaaagaagaatagttttcatatggcatttttcccgtcagtagcgggatttatagtaggacttggtaactgcgcgtgctacctgtttgtggcaataaaggcttttctgggagcatatggtgtaggaagcgttgttcagtatgtatcggtactgacaagattaggagatggaatcagagatttgatgtttatggtgtctgataatgaactatattgtgctcacctaaagaagatgtatgattacctggatatcccgaatcatatgtatcagggcagccttacagtggaaaaacgggaagataatgaatattacattgagtttcgtaatgtttcattcaaatatccaaggacagagaattatgtgctgcgtaatgtgaatctcaaattcaagattggagaaaaacttgcggtagtaggtatgaacggaagcggaaagacaacatttataaaattgctctgtcgtttgtatgacccaacagaaggagaaatcttattaaataatgtggacatcaggaaatatgactataaagaatacatgtccatattttctgttgtttttcaggattttaaattgttttctttcggacttggacaaaatgtttcagcaagttttcattacaatgaagaactcgcaaagaggtgtttagagaaggcaggtttttatgaacgcttgcagagtatgaagaaaggattagagacttctatctacaaagatttggacgaagagggtgtagagatttccggtggggaagcacagaagattgctttagcgagagcgctttataaaaatgctccatttattattcttgatgaaccgacagctgccctggatccgattgcagaatatgaagtgtattcaaaatttaatgagatagtacaggataagacagctatttacatcagtcacagactttcatcctgtaggttttgtgatgtcatagcagtatttgatggcggacagattgtgcagaggggagttcatgatagattattgcaggatacgcatgggaaatactatgagttatggaatgcacaggcacagtattacacataggtttatttgattcacttaagagaatgtaccgaaactattaaagaagttcaagataaactaatttgcaattaagaatcagtcttgacaaaaacgaacaaatattctatattatcaacggagattctataccaaaaaacagaaaatgtgaatatacaaacaaagctcaaactattgcagtttgggctttttccaattttgtaagaaacttgagaacaacaatttgcaaaaagtcaattaacactttgcgacagattatggacagaatttttcacaaaactgattgtgcaacactaacaattttttggggaatgtatagtctcgcaaaagtaacaacatggcaatcgagtagtatcggttgcttttttgttgctcacttttagaaattatcgattgccccggaagaatgatttctaaaagaaaccagatgtcaaaaggaggaaatgcaaaatgaaagagtattcaaaaggtatttatgtgaaatttagaccggaggaggtggagatactgcataaccgaatgaaggaggcggagttcaaaatatgagtgcctttatcagaaagatggtattgaacggatatatgattattcctgagtggcctgaactgaaaggggtgctgtctttgcattcaagaattagcaataacctaaatcagtatgcgaagaaagcaaatgaaaccggaaaattgtacgaagaggatattgcagaaataaaaaagatgcataatcagcaaacagaatttctgaaaaaggcacttgaggcagttcttggtttttctgaaacggattcatagtgttaacatggctctgcgggttatccgcagttcaaggggattggggtgcaagacgtccggtggacgtctgctctgcacggaccggagtggaacggagaccttccccaacaagcaaaaatgcgccgggtatataccggagcactgcttgccaatttgtaaaaagagaaaagaaaggattaagtttatgagagatttagaaaaggtatgtattcaaccgaagtataactattgcaccggtgaggagcgttttactttcatcaagctgccaaaatgtctggtagaggatgaaggctttgttgaactgtcaatggatgcaaagcttttatacgcattctttttagatcgagtttcattgtcaataaaaaatggatggattgacaaccaaccaagggagggtgtttatctattattcaataaaaaatatttgcgaggatttgaattgtggaactcaaaaggcatgcaagttattggatgaattggaaaaggtgggagcacttgaacggaagagacagggattgggaagacctaacaagctgtaccttaagaaaatgttttgagaaatagccataccgtaaaaatcaaaatacaaaagatggagaaatcacaattaagaattttgattttgacgcatacagacttttggtatttacaggttttgaacagtaaaaatcaaaatctaataagactaataataacaatactaattttaataatatctatcttatcctatcaggaagtgaagaaacatcactatggatgggatacgatggatttcaatgacaatgtcagaaaggattttaattatggttaagaataaagtggttttaaaagaaagagatgtatggagtgatttggcaaattttattggagaaatggtagcaaagtatgcggaagcaatggacttggataatttgcctgatccggatttttatcttcgtagggaaagaataagacagttgtacacggagctatataaagagaagaatataacaaagttcagaaatacaaaaatctcaattgaaagaaaagttgcagcatgatactataaccgtatagacggataaataaatttataaatacggatatgtacggaatgttgatggaggaaaaatcatgattatcagtgaaagaattttttgtgtgatggagcagaagagcataacgcagttggaactctcaagaaggaccgggattgcaacaagtaacatcagtgactggaagaagaaaaagacgaatcccaaagcggactgtctgttgtctatatgtgatgcattggagattactcccgaacagcttttgactggaaaaggaattgatccggaatataaagatgcagatatggattatgaagttaccaggtcggatattaagattttaaagcagattcacagccttggagatgcgcagtataaaagattgatggcgtatatgaaagccttgcagaagttggaacagatggagaacatggtggaggaatagagatggcaaataaaatagttagggaaattattcacgcaaaaggaattgatattgggatttacacgaaagattttgaaaatgaatatatttcgttgacagacattgcaaaatatagaaatgataatgatcccagatttgtcattcagaactggatgcgaaacagaaatacagttgagtttttggctgtttgggaagaacttcataatccagattttaaccgtgtgcaattcgaggcggttagaagtgaggcaggattaaacaggtttgttatgacgccaaccaaatggattgaacagaccaatgctattggaatagtgtcaaaagcaggcagatatggtggaggaacttatgcacatagcgatattgcaatggcatttgctacatggatttctccggaatttcaactgtatattatgaaagattaccgcaggttaaaacaagatgaaaatagtcgattttcattggactggaacttgaacagggctttatcaaaggtgaactaccgtattcacacggatgcggtgaaggaaaatttgattccaccagagctaacaccagaacagattgcttatacatatgccagtgaagcagatcttttaaatgttgctttatttggtcagactgcaaagcaatggaaaaataataatccgggtaaaaaggggaatgtgcgtgatgatgcaaatttaaatcagttgttggtgttggcaaatatggaaagttataatgctattttaattgagcaggggaaatctcaatcagaaagacttatattgcttagaaatttggcaatcaggcagatggatacattagtcagtatcaatctgtcggcagtttcggcacttcctggaggtgatatgtaaattgaagaaagagaaaatcaaagtatatttatacacccgtgtttcgacaaccatggctctagcagcctaagaaataattctctcggcatatgttatgctgggagaaaagttcaactttttgtgtccaaagtattgacatagacccaattccctgttatggtacgactcatgcggattatttctacggagaaatcccctctgtgagatgtctgacgaaggaagagattaactctgcttacgaagaaaataccggacacctgattgtttcggaatttaaacgcatgaagaaggatgtaatggcagttcctgcagtgttgtgcaagaatcatggtcctttttcctggggcaaggatgcaaaggaggccgtccacaatgcggtggttcttgaagaggttgccaagatggcatatcgaaccgagctgattcatccgcaggaattacaggataagcattatttccgtaagcatggtgcaaatgcatattacggacagaattaacaggatatcaagagggtataaaacagatgaagatgaaaacagcacctatggggtggaacagctgggattgttatggagcggctgttacagaagatatcgtacgacggaacgctgaatttatggctgagcatctgaaggagtacggttgggaatatattgtggtggatatccaatggtatgagccttatgctgcaaccaatgagtatcatccttttgcggatgtagtaatggatgagtatggaagactgcttcccgcagtaaatcgttttccttccgcagcaaacggtgcgggctttggaccattggcagaatatgtccattctcttggattgaagttcggcattcatattatgagagggattccacgacaggctgtacatcagaacacgaaaatcatgaacagtgacagacatgcccgggaaattgccaaaacaaacagtatctgtgcctggaatacggatatgtatggtgtagatcctgagaaagacggggcacgggaatactataacagtatttttgaattatatgcttcctggggtgtggattttattaaatgtgatgatattgcacgggaactgccacatgaggaatccgaactgattatgctgagcaaagcattgcatggttgcggaagacccatggttttaagtctgtcgccgggacctgctcttttagaaaaggcagagctttataagcagatttccaatatgtggagaatcaccgatgatttctgggataagtgggaactgttatatgatatgttttcaagagcagaaaaatggtgcacccatgcaggtgcagggcactggccggatgccgatatgcttccggtcggaccgatacggcaggtatatgatgtgaataactggacgaatttcacacaggatgagcagatcaccatgctgacactctggagtatcatgcgttctcctttgatgctgggaggagagctgacagggtttgacgaattcactatgaatctggtaaccaattctgaaatacttgccatgcatgcaaatgcacggcattcgcatcaggtgtggagacgtgaaatcgatggtatagagcatgcattgtggattgcagcagatacaaagggtggatattatgtcgcggtatttaatctgggtgataaagacagtgacatatccataccgcttgccgatctggagatttatgatggagtaaatggaacggagctttggagcggagagcacgtggaagagcaaaagagccttagtgtgtcattaaagagtcatggtgctagggcatatcattttacgtacaactaaaaagcatactactgttaatgtatagataagaaacaaagataaaatagtaaaaatagaatagaacaaagaaagaatatggagataaaacagaaaggaataaacaatgaatgtaaatcctataacaagattggattatccagatctggacgtgatccgcgtagaagacacctattatatggtatcaacaaccatgcactttatgccgggctgtgagattctgcagtcttttgatctggtgcactgggagcatgtgacttatgtctatgagacgttggatcatacggatgcgcagcaactgaaaagcggtcagaatatttacggacagggcatgtgggcagcttccctgcgctatcatgaaggccgattttatatctgctttgtggcaaatgatacccgtaagacttatttgtatacttcggaaaaaatagatggtccatggaaaaagcagctgatagaaggcttttatcatgacggctctttattatttgatgaggatggcagaagctatattgtatatggaaatgatgaaatctggattacagaattgaatgaagatttgactgcaccaaagaaggacggattacatcgtcttttagtcagtgatcataagaacccggagctaggctatgagggttctcatattcaaaaaataaacggctattattatatttttctggttcattccctgagagaccgctggatgcggacggaagcatgcttttacagtgattctctggaaggagaattcacgggtggagatgtactttgtgatgatcgtggatattgtggacagggcgtggcacagggaggaatagtggatacgccggatggaaagtggtatgcaatgctgtttcaggattccggagcagttggacggattcctattctgcttccggttacctggaaggatcattttccgttttttggacagaacggacatgtgccggaagaaatagaggttcacagtaccagaccaggatatatttatcagccattagtgggaagtgatgatttccgtaatgggctgcttccgcgctggcagtttaatcatgatccagatccacggtactatcatctggatgcattgcagggaacctatacaattacaacacgggaagtttgtacagagcttacacaggcagtaaatacgcttacgcaaaggatgagttatccgtcctgcgcagctgaggttactgttgatgcttctgcattgaaagagggcgatgtcgcaggtttgtgtgcgttgcagggctgttatgctgcagttggcattacaaaacgtcatggaaaatatgaagtccttatgctggataaaaaagaagatggtatattggatatgacggaaggaactgttgttgaatcacaccagatggattttcgtcttgaagcagatttctgtaacatgaaggatgaagcacgctgctattaccgggtaaataagggagactggctacccatcggaaccgtgcataagctgtacttcaaactggatcattttactggttgccggtttggtctgttctgctatgcggcagaggaaacaggaggaagtgcctgcttccgggattttaagtattatgatgttgatgaaatctcataaagatagaactgcataaaataagtgtcggaatttactcaaatttttcctactttggacattggtttttacaacggtattgtatagtgaagcagaggaaaaacaaatatggaatgctgcagaagagattgtgatgaaagaattagtgtatattgaaagcgtggaaagctccttcgggagctttttgctgtttataagataaattctgtcggagcttttgacttaatgatttgatttataaaactggcaatgatacaattagcgtaatttgaaagaaagcagagaaaatatgagtgaaaagttactgattgttgaagatgacaaaaaattaaatgatggaatccgtctggctttaaagaatgatgcttatttcttttatcagtgcagaactttgcaggaagctagagaaatcttgaaaaaggaagatatcacattggttttattagatgtgaacttgccggatgggaatgggattgattttgtaagagaaataaggaaaaacagtcaggtgtcgattattttgcttacagtaaataacatggaagtagatattgtaacaggattggaagctggggcaaatgattatattacgaaaccgtttagcttgatggttttgcgtgcaagagtgtctgtgcagcttagaaataaagaggcagcagctaaaaattctatggagcttgatggatttgagttctatttcgataaaatggaatttttcaaagatggagaacctattgaacttagtaagacagatcaaaagctccttagagtgctgtgtgaaaacagaggaaaagtattgaaacgggaatatctgattgacgaggtatggcagggagatatagagtttgtggatgctcatgctctgactgttgcagttaaacgcctcagggacaaattagaagatgatacgcagaagcctgaatatatcaagacagtctatggaattggttatacctgggcggtgaatggatgatagaactaattatattgattgtaggaatatttgttttaagtggaatcttctggcatagcattttttatcagaaagaaaaaaagcttttgaaccggctgcagcaaatgctggattgtgctatagatggagaactggaacggacagaaatatcagaagaaaagtattctgctcttgaaaacagcatgaaacaacatttagacagtagctttctggcaagaaagaaccaacaggaagaaaaagaagtgatacagaaacttatttccgacattgcgcatcagaccttgactcctatttcaaatttgaaaatttatggtgaaatactctctgaaacaaatcatgaaaatcaggaggagatagctaccattttggagcagacagagaaattagatttcctgatacaatcattggtcaaattatcacggatggagagtggaattatcgcagtacattcggaggatactactattgcacagatgtttgcatccgtacagcagcagtttaacgtcaaagtaagggagaagaatattactctgagcctatgtgacacggatttgcatgttcgatgtgatccaaaatggaccgtggaggcactcggaaatattgtagataatgcgattaaatacacagcatgtgggggaaatgttcaggtaaaagccgagcagaattctttctttgtaaagattgatatcattgatgatggcattggaatagaaaaagaagaaataccaaagatatttggacggttttatcggagtctgtcagtggcagaccagccaggagtaggaattggcttattccttgcaagagagatcattcaggcacaaaatgggtatataaaagtgacatcagagagagaaaagggctctaccttttctgtgtttcttccgatatcaaaaaaggaatagtatcaaaacggtgatatttcagaaaccagatggagacattgttatgataaagtctgtattgtaaagatcaatacaggcttttttgatgggaggatggcatgaatatattaaaagcagtgaatttaagaaaaatatatggacaaggagaaacagaagtcaaagcccttgatggtgtaaatttagaagtggaaaagggggagtttgtagcgattgttggaacttctgggagcggaaagtctacgatgcttcatatgattggaggattagataatccaacatctgggcaggtaattgtggatggacagaacttaagccatatgacagatgaagagattaccattttccgacgcaggaatattggtttcgtatttcaacagtataacttggttccgatgctgaatgtatgggaaaatattattcttcctgtgaaactggatggaaaaaaggtagaaaaaggttatgtagatgaaatcatagatacactgggcattcggacaaaattggaaaacctgccaagcgctctatccggtggacagcaacagagagtggcaattgcaagggctttagctgcaaaaccagccattttgctcgctgacgagccgactggaaatttggattcgaaaacaagtcaggatgtattagggcttctgaaagtaaccagtaagcgttttcaccagaccatcgttatgattacccataatgaagagattgcccagatggcagaccggattttacagatagaagacggaaaaattgtttcagacagtggtttggtatagtgagggcgtttatatggtaaaagtagagaataaagaaacgttacgattattgacgaaacgttttatgaaaatgaaccgagcaagaaatattattgctgttattgcaatcatgttgacatcactgttatttacaagcctctttgtggggagtgtatccatgatactttccaaaagagcaacggaaattaagcaatttatggattcatcccatgctattgcgcagaatttgtcagaagaagatgcgaagagattgcaaaaaacaatagaacaggatgaagaagtggaacgatatggttccggtatttttctgggagctggaatggacgaacggtttggattttccgtagaggtccgatatgcagatgaaaatatggcagaaagttttaattgtctgccaactacaggaagacttccggagaaagaaaatgaagtagcacttagcagcacgatattggaatctctgggtgttacaccaaagattggggaagaagtaacgctgacgtgggaagtaaatccgatgctgaaacaatataagacacatacgtttcagatatgtggattctggcagggcgataaagctgttttaggtcagatggtctgggtatccgaagcctatgcaaaggagaatcgttatcccgttacgcaggaagaattagaaaatggcatctacaatggagggaaagagtattctgtctggtacaagaatctttggaatctggaaaagaaaacagaaaatatatctaagacagcaggatttacgaaagcagggacaggattggagatcaatccggcatataatctttttgaagaggattcattttcattcacttcctttattgtaatggtactgtttgtgatattggctggttacttaattatttataatatttttaacatttctgtgaaaacggatatccgggcttacggattgttaaagaatgtggggacaacgggaaagcagttgaagaaaattgtacgtatgcaggcgtggagattatcagctattggcattccaatcggattgctttgtggttatcttgcaggtctttgtatggctccgtccttgactgcagatgctgaaattagtgcacaggcaggaaaaacggctcagacagtagtatcagccaatcctttgattttccttgcatcgatacttttaacgcttttaacggtgtatctctccagtctgcaggcttgtaaaatggtggaaagagtttcgcctgtggaagctctgcgtttggcagaaggagagcagtcacataggaaaataaaaaagaatacttctgtaacctggtgggggatggcagttcaaaatgtgttacgaaattggaaaaagggattgattgttatgctttctatcgctctttctatggtggttgtcaactgtatcgtgatgttggtgcagggatatgattttgagacttaccagaatataattttagcatctgattttcaactggatcagatgaccgacactttatcgaatacaaattttaacggtattacacctgaaatcaaagagattctgaataagtgtccggaaagtgagaaaacaggatatgtgtattattcggaagaaagacataagatggaaccggcacttttgaaaacgtgggagacattggcagaaaaaaacaaagaaaactggacagattatgaaaagcaaatctgggaggaaacaaaagcggataatactgtaaaggttcatttcctcggaattagtgaagcggtgtttgatatgttagaatggaaaggggaaaaatgttcctggaatacgtttaaaagtggggattatgtgattgtggactatagtgataaatatacagaacaaccagtttcttattatcagtctggcgaaacttttaaaatggagtacggaaacggaaagcagaaagattatggggtgatcggagaagctatgatgccatattccctggattatccgtatgcagatactgtttatattacagtaatggtcccagaggaagagtatattacccagacgggaaatgaatcagccatgtatgctgccatcgatgcaaagaagggcgaggacaagaagataaaagaatacattgatgaaaatattttgaaagaaaatgatatgatcaatgttttttctgtattggatatgaaggcgagctttaggcggtttgtcagtaaatattatatgatcggtagttttcttgtcgttattttagcctttattggcattatgaatttctttaatacaacagcaacttctgtaattagcagaaaaaaagaactggcacttttggaagttgttggaatgacgaaaaaacagatatcgaaaatgctagtggctgagggattcctatatttgggaggcgcatttatgattgcagtattgttagttgtggttggagcaaagcagattttaataaatacgcttggtacggcatttttctttcaactgcatcttacaatcgtgccgtgcctgcttatggttccgatattaagtggaattgcatatgcgattccaaagtatcagtttaaaaagatgagtcaggaaagtgtagttgaaagaattcgtaaggaataataacaatatataaatcaggcgtatggaagtatattaaagaagagcggtatgacgatggtggagattgcgaagcggaacaatgtcagtgagcggacgatttataggtataaagaatataaaaggtcgtcaggaatttatgcggatgctgaatgatattgaagacggcagaggatgaagtgaaaattattcaaatggtttttgacaggtatattcataccaatgatggaatcaatggtgtggcaaattatctgaacaatcatggattataatgcaaaaaaattgattgtataaaagaaatgggtaagttataatataggtgtggtcagatgccttttggggatgacgatatctgttacaaaaaggagaaaggccagtgaatacagaattgaaaaatgaagtgaaagcgattattgcaggaaaagaacctgcacttgcataaagttatgtaagaaaaagagcctttgagttaaaatgacttggaggctcctgttatttttcagtaaggagttaggagtagtaaatggatattaatagacagcagaaagctccaatttatgaggcacttgaggaatttaaaaaaagaagagtggttccatttgacgtgcctgggcacaaaagaggcaggggaaacccggaactggtacagctgcttggacaaaagtgcgtggaactggacgtaaattccatgaaaccactggataatttgtgccatccggtttctgttatccgcgaagcagaagaactgacggcagatgcatttggcgcagaaaatgcattcctcatggttgggggaacgacatcggcagtgcaggcaatgatattgtcaacctgtaaggcgggcgataaaattatattaccgagaaatgtccataaaagtgcacttaatgcactggtgctctgtggggcagttccggtttatgtgaatccggagatgaatgcgaaacttgggatttctctcggaatggaaatagaccaggttgccagggcgattgaggacaacccggatgcaaaagcggttctggtaaacaatccgacgtattacgggatatgttcagacctccgggcaatcgtaaaacttgctcattccagaggaatcaaggtgcttacagatgaagcacatgggacgcatctgtattttggggaaaaccttccggtatgtggtatggcagcaggcgcagacatgtctgccatctccatgcacaaatccgggggaagccttacacaaagctccatccttcttaccgggaaagcggtaaaagcagatcatgtcaggcagattatcaatctgacacagacaaccagtgcatcgtatctccttttatcgagtcttgatatttcaagaagaaatcttgcgttgcggggaagagaatcttttgccagagttgcaaaaatggcagaatatgccagaaatgaaattaattctattggcggttactatgcctatgggcgtgatctggtaaatggaaccagcatttacgattacgatgtcaccaagctgtccgtttatacattggatatcgggcttgccggaatagaagtatatgacctgctccgggatgaatatgacatacagatcgaattcggtgatatctgtaatatccttgcgtatatttccattggtgacagaattcaggatattgagagactcgtaggggcattgcaggatatcaagaggttatacagcagggacaggacagggcttttgtccggggaatatatcaatccggaggtggcggtatctccgcagaaagctttttatgcagaaaaaaaatcgctaagcataaaagattccgtgggatgcatcagtggagagtttgtcatgtgctacccaccggggattccgatccttgccccaggggaacggattacaaaagagattgcggaatatattctgtatgcaaaagaaaaaggatgctccatgcagggaaccgaagatccggcagtggaatatcttcaggtactggcatgagtggcaacaggaggtaaagatatgcaaatgtggttttcggaatatcatacagttaatgtaaaactggatgtccggatagaggagcagcttttttcgggaaaaagtgaatatcaggagatagatgtatttaaatcctatgaatttggaaaaatggcagcattggatggtgaaattgttttttccgatgcagatgaatttatatatgatgaaatggtgacccatgtgccgatggcagtccatcccaatgcaaaaaaaattctgattattggtggcggggatgggggtgtggcgaaagaactcataaaatacccgtttgttgaaaagattgacgtggtagaaaccgataaaatgtttgttgatgtatgcagaaaatttttcccggaggtggcatgtgggttagaggatcccagaatttcaatgtattatgatgatgggcttagatttctgcgcgggaaaaatgatgaatacgatctgatcatcaacgattcaacagatccattggggcatacggaaggactttttacaaaagaattttacggaagctgttataaagctctccgggaggacggaatcatggtgtatcagcatggaagcccgttttatgacgaggatgaggctgaatgccggaaaatgcacagaaaagtctacaagtcattcccgatcagccgggtataccaggcacatatcccgacctgtccttccgggtactggttattcggattcgcttctaaaaagtatcatccgctgaatgatcttgatgcagaaagatgggatgcacttggaatgaaaacatggtactatactacaaatttacaccggggggcatttatgcttccaaaatatgtagaggacttactcgaagaggaagaaacccggtaaaacaaatgatacaggaggaataaaaatgagcagattacttattattggatgtggcggtgttgcacaggtggcaatcagaaaatgctgtcagaacagtgaagttttcacggacatcatgattgcaagccgtaccctgtcaaaatgtgacgatttaaaggcaaaacttgaagggaaaacagcttccagaattgagacggcaagggttgacgcggacaacgtggaagaattaaaaacactgatccgttcgtaccggccggatgcagtgctcaatgtggcactcccttatcaggatcttacgattatggatgcatgtcttgcctgtggagttgactatattgataccgcaaactacgagtgcgaggatacgcaagatccacagtggagggaaatttatgagaagcggtgcaaaaaactgggatttaccgcttactttgattattcctggcagtgggcttatcaggaaaaattcaaggaggcaggacttaccgcaattcttggaagcgggtttgaccctggtgtcacatcggtatttacggcatatgcgcagaaacattattttgatgaaatccacaccattgatatacttgactgtaatggcggagatcatggttatccgtttgccacaaactttaatccggagataaatcttcgggaggtatccgctaacggttcctactggacggatgggcactgggtagaaaccgagccgatggagtggcgggcacagtataattttgaccaggtcggagaaaaagatatgtatcttctccaccatgaggaaatagaatcccttgcaaaaaatattccgggtgtgaaaagaatccggtttttcatgacgtttggacagagttatcttacacacatgaaatgccttgaggatgtgggaatgctccggacagacccgattatggtagacggaaaagaagtggtgccgttacaggtgttaaaagaactgcttccagatccggcatcacttggaccacggacagtagggaagacaaatatcggatgtatttttaatgggataaaggacggaaaaaagaaatctatttatatttataatgtatgtgaccatcaggaatgctacaaagaagtggaatcacaggcagtttcctatacaacaggagtaccggcaatgataggttccatgatggttgtgacaggactctggaaaaagcccggggtattcaatcttgaggagatggatccggatccgtatatggaagcactgaataaatttggtcttccatggaaggtagttgaaaatccggtatccgtggattgttacaagacagcagacccttctgttcatatggattgagccggagggaaggatgaagattaatgaactgaaaactccctgctatgtgatagatgagggaaaactgacagaaaacctgaagattttgcatcatgtaatgcagagaacgggcgcaaagatccttcttgcacagaaagcattcagcgcattttgtgaatatcccctgattggaaaatatttaagtgggacgacggcaagcgggctgtatgaagcacgtctggcacaggaagagatggggaaagaaaaccatgtcttctgtccggcatatctgccggaagaaatggacgaactggtaaaaatatgtgaccatattgtttttaattccgtttcccagtttctggttcataaggaaaaaatcaaagaagcagccgcaggggtaagtacaggacttagaattaacccggagtgttctacacaggaagggcatgagatttatgatccgtgtggtacaggttcaaggcttggtataacgagggcagagcttgacaaagccatacaaaacggttttgacctgtcgcagatagatgggtttcacttccatacgctctgtgaacagaattcggatgccctggaaacgacacttgatgccgtggaaaaaaagtttggagatctgctgtacggacggaaatggcttaatatgggtggcggacatcatatcacgaaagccggttacgacatggaaaaactggagaactgtatccggcgcatgcaggaaacatatgaccttgaaatttatcttgagccgggggaggcagtagccctgaatgcaggctatcttgagacaaccgtgctcgatattgtcgaaaacaatgggataaagatattggttctggacacttcggcggcatgccatatgccggatgtactcgaaatgccgtatcgtccgccgcttaaggacagtggaaaagcaggggagaaagcatatacataccggctttcttcctgtacctgtctggcaggtgatgtgatcggtgattactcatttgataaagagataaaagtgggcaacaggcttacattctgtgacatggcaatttattccatggtcaaaaataatacgtttaacggtatgccgcttccggacatcgcagttatgggggcagataaagaatgcagggtaatcaggagatttggatatgaagattttaaaggaaggttgtcctagcaaggatggatttcatatgccggcggagtatgaaccgcataaagggacaatacttatatggccgaaacggccgggttcctggatatatggtgcaaaaaaggcaagagaggcttttgcggatgtcatatgtgccgctgcggaatccgagacggtatatctgctggtggaagcaggggagctggatcatgcacaaatgataattgaagctgtccggaaagaaaaaaactatcagaaaaattatccggtccattatatggaaattgcatcggatgatgcatgggcgagggatgtcggaccgacctttgttgtcaatgggcaggggcaggtacggggaattgactggtgttttaatgcatggggtggaatctgtgacggattgtatgcagactgggaaaaggatgataaagtagcgtcctctttttgccggaagacaggatatgatctgtatgatgcgcatccgtttgtgttagaaggcggggcaatccataccgatggagagggaaccatccttgtgacagaaagctgtctgctcagcaaaggcaggaatccggaactttcaaaagaaaagatcggacagaagttaaaggattatcttggggcagaaaaaatcatctggattccatatggaatctacaacgatgagacaaacggacacatagacaatgtctgtgcatttaccgctcccggacatgtggtgcttgcgtggacggaggatcccaaagatccgcagtatcccttgtcatctgccgatcttgcaatattggaaaaagagacagatgccagggggcggaagctcatagtccacaaagtcccggttccggggaagccggtttgtataacggaatatgaacttgccggtttttcctttgaagagggggaggagcagcgaaaagcaggggagcggcttgccgcaagctatgttaatttttatattacaaatggaggagtcctgattccccagtttgaggatgaaatggatgcagaggctgtgaacatcataggggggctttttcccggaaggaaggtatacccggtttacgcacgtgatattattgtcggtggtgggaacattcattgtattacacagcagataccggctgattccgggaggatgggaggagcatgatatgagaaaaaccacagtggctgccatacagatgggctgcggcagcgatgtaaaagaaaatatagaaaaagcatcggaactgatcagggaggccgctgcacagggggcgcaggtcattcttccccctgaacttttcgaaagaccgtatttctgtcaggagagaaggtatgaatattatggatatgcaagaacgccagaggaagatgatgctgtcatccatatgaaaaaactggcaaaagagctggaaacggtgattccggtgagcttttatgaagccggggatcacagacagatgttcaattccgtggcagtcattgatgccgatggaagtgtgtgcggcatttacaggaaaacacatattccggacgaccattattatcaggaaaaattttattttacgcccggtgatacagggtttcgggcatttaaaaccagatatgggacgattggggttggaatctgctgggatcagtggtttccggagacggcaagaggcttggcactaaaaggggcggaactccttttctatccaactgcaatcggaagcgagccgatacttggctgcgacagtatgccgcactggagacggtgcatgatggggcatgcggcatgtaatcttatgccggtcattgctgcaaacaggatcgggacagaaaccgtggaaccgtgcgcggaaaatggacagcagagctcagccctcacgttttacggttcctcttttatcacagacgcaacaggggaagtgacagaagagatggacagggtatcagaaggctttatcctgcatacgtttgatctggatgaaatagaagaagaaagaagaagctgggggctgttccgggacagaagaccggaaatatatttgaaagaatagtgatggtgcggctgcacatatggaaaatttctgtcatatgataaagcatacctgaataaaatgaaaggatgcaaaaaaatggcaatatttaccaatcaggcacagctccgctatggaaacgctgtagccaattccaacgttgcagtgggagaaatccttgaggtacttgccgcaaccaaaactgcggtacgcaaaacatacgggcagaatgaccgtgtcacctatgttgtgagcatagtgaattccggaaatacagccatgacaggactgacggttgcagatgatctgggggcatatgcatttggcacagacacactggtgccactgacgtatgtggcagataccgtgcgttattacagcaatggaatcttacagacaacaccggcggtcacggcaggaccacccctttccgtttccgggatcagtgtaccggcggggggaaacgtgaccattgtatatgaggcagaaaccaatgcgtttgcacctcttttggcagaatcggagattaccaacacggtgaccgtttccggagggggaattacaccggttaccgcaaaggaaaccgtcatcgcggaaagtggtccgaagctgacaatcaccaaatctgtcagtccggttccggttacggaaaatggaacactgacctatacgttccttatccagaataccggaaatactgcggcactggcggcaaccggcgcagtggtgacagacacattcgatccggtactttcgaatcttgcggtatcgtataatggaacggcatggtcggatccggcaaattattcctacaatgccgcgaccggtacttttgcgacacaggaagggcagattaccgtaccggcagcaacctttacgcaggatgccacaaccggcgagtggacagtgacaccgggggcaggcacacttaccgtaaccggaacaatctgagttttctttccaggggattaccacgaaatgggtggtaatccctttttgcgtgacatggcacagtgttgagtgaacagtaacttggtgcttgcatttccggtatagttatggaataattaaaagaaaacatatgaatgcaaaatataaagtataaagtgtaaaggactgggtgggaaactgaaagatgaaaaagtatatggggaataaaaaggaagtacttttattttatcttctgatgattgcggtgattggctggtttgtggtagcggagacagtgtatccgtcagaacatatcaaagcttccagaccggagaatcttgcatacagggggacatttacctggcaaagagatcaatgatgaccattatggacagaagcgtattatatcagattaacggtctggagaaaccacagaaaatcagtggatttttaaaagaaaaagggtattcccggcagaatcttgtggatctgcgcaaagacgaacaggcaatctgcctgaacggaacgtatgtacatatgaaccacatgcttgcagaaggagatgttctgacggtatggattcgggaaacggaaaattccggacagatccgtccggtaaaactgccgtttgccatcgtttatgaggatgaggatctgcttgtgatcaacaaaccggcaggaatgccggttcatccatcccgcgggaatccggagaattctctcggcaatgcactggcatggtatttcaaagagcagggggttccctttgtgttccgctgtatcaaccggctggaccgggatacctccgggcttactattgtggcaaaacatgcggtttctgcggcgatcctcgggcagatggtgcgggcaaaagccgagcagggactaaaagcacccgggattcaccggacgtatcttgcgcttgtggagggaaaggttgtgccggtttccagcgtcattgatgcaccgattgccagacaggaggaccgctgcctgcgccgcgttgttgattttaagcggggagaccgggcggtgacgcattaccgggttctgaccggatggcagaccggaaatgcacagaagttccgcagtctggtaaaacttcagctggagaccgggagaacccaccagatccgcgtgcatatggcatatctgggacatccgctggtgggagattttctttataatccggcatatggggaaaatcagattgaccgtcgggacgatgaaaattccggggagagacagatttttcagggaaagactttttcctgtggaaaagagcaatatgatattggccgtcaggcactgcatgcatggaaactttcgtttccgcatcccatgaccggacagccgatgaattttacggcaccgcttccggaagatatgcagcgcctgctgaaatcttaaatccgctgtgcacagatatcctgcaggcagcagtgttcgcagtgcggtgtggtgcgggccgtgcagatgtcacgtccgtgcagtacaaaacggtggcacagatcgttgccttcttccggaggaatgatcttccacaattccatttctactttctttggatctttgatgtgatccaccaatccgatccggttgctcaggcggatgcagtgcgtgtccgtcacgatcgccggttttccaaatacatctcccataatcagattggcacttttgcgtccgacacccggcagctttaacagggcattaaaatcgtttggaacatttccaccatacacatcccgcagcatccgcatgcaggcactgatatcccttgccttgctttttcccagtccacagggacgcacgatttcttcgatttcttccacgggtgcatctgccagggcattgacatccggaaatttttcatacaatttcggtacgatcatgtttacgcgggcatcggtacactgtgcggccaggcggacactgacgagaagcttccaggcttcgttgtaatctaggctgcaggcggcatccgggtacgcctgtttcagacggcggatgatttccagcgccagttcttttttattttccgtatgcatattcccagtcctctcttttcgtatttgctttattttacataataaatgactgtttttcaagttgcggattgccgaaaaaaaaggtaagataatacgcatgacaataagttggtgatttcgaaacttttttccgagcctgcagcctctcacatggtcggatctgcgattaacgttcaatagtttctgcgggccgtctgtctgtaaggacaccgtctgagtgatttcgtgtgtgccttagagggaggcttcgaataagcgcgcccacggttcaatttgcgcagtcacagaataaaatatataaacggttgtatatatcaagacaaatgagagtgggcgcaataaacgtttcgaaggttccctcttaggcagactagaaatcgcgaacggagtcccttacagacagacggcccgcagaaacggtcgaaacgatacccggacacaaaaacgaaaacaggagagaatattatggagcgtatacatgcagttacctttgcaccattttgtgcaagaggtacctttgaaaaagaagaaaccagacagagtctgaaactgatgaaagaaaagacgggagcaaactatgtgatttttgcaccgaacggtgtgcagaagacagcattttccgagaacattgattaccggaccaagcggaatgtatcggatgaggagctgactgccatgattgcttacgcaaaacagcttggccttaaggtggcgttaaagccaacggcaaactgtgcggacggaacatggcgtgcacatatcaatttctttgatgaagatgtcgtgtgtgaaccgaagtggagcaattggttcgcctcttaccgggcatttcaggaacactatgctggacttgcgcagcagtgcggagtggatctgtttattgcaggctgcgagatggtgcagaccgagcgacgcgaagcggaatggcgggaagtgattgcggcgatccgccggaagtatgacggaccggtttcctacaataccgataagtatcaggaacacaatgtgaaatggtgggatgcggtagatgtgatttcatccagcgggtattatccgattgacgattgggacaatcagctggatcgtattgaacaggtggtaaagaagtttgataagccgtttttctttgcggaagccggctgtatgtctgtgaaaggttccaatcaggtgccgaatgactggggcgtgcgtggggactatgatgaaaaaggacaggcagactggtttcaggcgatgtttgatgcctgcgaaaagagagactgggtaggcggatttggcatctgggaatgggctgcatggcatggagatggcagaaatcctgtcaaaagaggggattatgaagtctacgggaaagcggcagcagacatcatctatcggaaattttcacaagtttcagaatgaaaatttagcttaaatttcgactaaaaacatatttacacaaacttaaattatggtatactaaaataaaaaagccgaatagaagggggacctgaaatgagttatatggatacatacaagaaatggtgcacagacaattattttgatgaggataccaaaaaagaactgctggcactacaaggaaatgatgcagagatcgaggatcgtttttaccgtcagctggagtttggtactggtggtctgcgcggggtaatcggcgcaggaacaaaccgtatgaatatttatacggttcgtcaggcaacccagggactggcaaactatatcatttcgcagaacggacaggacaagggagttgcgattgcttatgattcccgtatcatgtccccggagttttccgatgaggcagcgctctgcctgaatgcaaatggtatcaaaacctaccgttttgaatccctgcgtccgacaccggagctgtccttttctgttcgggaacttggatgtattgcaggtattgtaattacggcaagccataatccgcgtgagtacaacggatacaaagtatactgggaggatggcgcacagattactccgccacacgataaaaatattcttgcagaagtggcaaaagtcactgatttttcacaggtgaagactatgatgaaatctgaggccgaagctgcaggactttatcataccatcggaaaagaaatggatgaccgctatatggaagaactcaaaaaacagtcgatccacccggaaatcatcaaagcgatggcaaaagatatcaagatcgtttacactccgttacatggaacaggaaatctcccggtacgccgtgtattaaaagaactgggatttgaaaatgtctatgtagtaaaagagcaggaacttccggatggaaatttcccgaccgtttcctatccgaatccagagtcgccaaaggcatttgagcttgcgctgaaactggcaaaagaagtagatgcggatatcgttctggcaaccgatccggatgccgatcgtctgggtgtttatgcaaaggataccaagacaggagagtatgtaagtttcactggaaatatgtccggtatgctgattgcagagtacattctgcgtgagaaaaaagcaaacggaacactcccggcaaacggtgcactggttgagactatcgtaaccaccgacatggcaaaggcaatcgcaaaagcttacggagtaaaactgatcgaggtactgaccggatttaagtatatcggtgagcagataaaattttttgagcagcagaacagttatgagtatgtctttggcctggaagaaagctacggatgtctggcaggaacttatgccagggacaaggatgcctgtgtggcagtcatgatgctctgcgaggtagcggcatggtgcaaatccaatggaatcacgctctgggatgacatgctttccctgtacgggaagtacggttattacaaagagggattggagaccatgaccttaaagggtatggatggtgcagaaaagatccagagcatgatgaatgagatgcgcaacaacccgccgaagaagatcggtgcatgggatgttttagcacttcgtgattacaagaaagatacaagaacagatatgacaggcggagaagttacaccaaccggacttccggaaagcaacgttctttattatgaactgagcaacaatgcatggtgctgtgtacgtccatccggaacagagccaaagatcaaattctattttggcgttgtaggaacggacatcaaagattccgaaaagaaactggatgagctgcgcaacgcaatgcttacatacgcaggagaataaaatttatggatgatcagaagaatataaaaccggatttttccaaagcaggagaagacagcatcctctataaaaaagaggagccgaagacagaaagagaaaagttaaaggaactgcatggaacagacaaagtgtggtatctggttcaatactatgggttgcagacggtagtggcactggctgttataggaatactcgcttttctgatcgtccattatgttacacaaaaggatacagcactggaaattatggcggtaaatgccatacagtctgaggacaatccggctggggattccggttattataatggtttcctaaaagaaaacggactggatccggataaaagcgaagtgcttgtcagcagtaatctgggagcctcggcaaatgaaaacgacggggcatccgcagagagcattcagatgattcagagccgctttatgacacagtcggtagatgtcttttttgcggattatgatttcttttattcactgggagagtttgactatctggcagacatccgggaatatttgccagaagaattgctggaaaaatataaggacgatctggtgtatgtaaaaagtaccgaaacagggaaaaaatatccgatcggcataaagttagaaaaaaatgcctgggtgaaggaaaccggctggtatccggatacctgtgtggtaggtctggcagaaggtttaaaaaacaaggacctggcagtgaaatttatagaagaaaacatactggaggattaacatgagtatcgtatttgatgaaaatctggatctgttttgtctggagacagcgaataccagctatatcataggtcttgcagaccaccggacctttgtaggtcatgtatattacggcaagcgtgtgcgcggacaggatctgcgctacctgctccgtaccggagaggcgccgtttgttccatcggagaatgaaagagagcgctgttctttttatgatacgtttccatcggagtattccggaaacggagtgggagattatcgggaaagcagcattgctgtgcgaacacaggcaggtcagcatgcggttatgccgacgtatgtttcctatgaaattacagatcagaaaccgcagcttccgggacttccgtccgcatttgacagggagcataccgcacagacactgattcttcactgcagggatgaagtgttgcagctggatgtggatctgtattataccgtgtttgaagaaaacgatatgattaccagaagcgtgcgcatcagcaatcagagcaaagaggcagtttacctcacaaaagcatattcggcatgcctggatatggatgatgatgcctacgagatgctgacacttcacggttcatgggcaagagaacgccagatggaccgccgtccgctgggatatggaaagaccagtgtgggaagtatccgtggggagtcctcccatcaggaacacccatttatggcatggatgaaatcttccacgacacagacatccggtgaagtgtatgccatgcattttatttattccggcaattttatcgcacagctggaaaaaagccagtttgacagtatccgtgcagtcatgggaattcatccggcagatttttcctggaaactggaaagtgaagaatcattttatacaccggaagctgtccttacattttccgcagagggacttggaaaaatgacccgtaatttccacgacttctatcggaatcatttaatccgtagcaaataccgcaatcagaaacgcccgattctgatcaacaactgggaagcaacctactttgatttcaataccgaaaaacttttagatattgcaaaacttgcctctcagtacggaattgaaatgctggttatggatgatggctggtttggacaccgcaacgatgacagtacaagtcttggggactggtttgtgaatgaaaagaaactgccgggcggattgaactatctggtagatgaagtgaataagcttggcatgaaattcggtatctggatggaaccggaaatgatttccccggattcggaattgtacaaagagcatccggactgggcaattgctgtgaaaggacgcaccggaacgctttcgagaaatcagtatgtccttgatttcagcagaaaagatgtgagggactgcatctatgaaaagatccgtgcaattttaagcagtgccaatatcgaatatgtgaagtgggatatgaaccgtcagcttactgatctgggaagccttgcgcttccggcagaccgccagggggagttaagccaccgttatgtgcttggtgtgtatgagatgcaggaacgcctgacctgtgatttcccggatcttcttctggagaactgttccggtggtggagcacgttttgatccgggtatgctttattacagcccacagatctggtgctcggatgatacggatgcaatcgagagacttggcattcaggaaggtacggcactgatttatccactgtccgcaatgggagcacacgtttcggactgcccgaaccataccgtgggcagaaataccccgtttaagacaagaggggaagttgccctggcaggaacctttggttatgagttggatatcacaaagattgcaaaggaagagcaggaacagattccacagcagacagctatgtatcacaagtataacgatctggtaagggagggggattattaccgtatcgcttcttaccgggaaaatcatttctacgattgttatatggtagtatccaaagataaaaaagaggcactggttactttcgtgaccgtacacgcacgcccgaattaccacagtttaaaagtacgcctgcagggactgaatccgaatctggattatcgtctggaaggtgagatggagaacgaatgcgtatacggtggagatctgcttatgaatgccggtatgctggttccttctgagcagggggattacagaagttatctgtaccattttgtggcagattaattgacagaggaagaaaaagaatgtaaaattaacttaaattatccagtttatatagttaaataagtaaattagtatgaaaatatcgagggaattatggcaaaagcagtgaaacttgcagatatcgccgaacaggttggtgtcagcacggtaaccgtttccaaagccttgtcgggacaaaaaggcgtcagtgaagagatgcgggagaaaataaagaaccttgcagaagagcttggttaccgcagtccttcggagacaaaacggcagtctgcggaaaaacaatataatatcggtgtattaattcaggaagtttatctggacaaatacaattctttttactggagaatgtatcaggaagtgaataaaaaggcagtttcccgtgggtgttttacgctgttggagagcatttcaagggagagtgtgctggaaaaccagatgccgcttctgcttcaggaaaaaaaggtggatggtctgattattctcggagatatgacaaagccgtacattgaacagattgaaaaagagggcggcgtgccagtggtctgtctggatttttataacgatgccgttggtcttgacaccgtgatttccaacagtttttatggaacctatgcgctgaccaattatctgttttccatggggcacacaaaaattgcctatgtaggaacggttggcatgacaaacagtattacagaccgatatcttggttaccgcaagtctatgatggaacacagagtggatgtgccaaaagattatgtgattgatgaccgggatacaaaaaccgggcgtatggatctggaaaaatattacagatttccaaaagatatgccgaccgcgtttgtctgtaactgtgatcttgcggcatcctacctgattcgtaaactggaaggtgccggctacagggttccggaggatatctctgttgtcggatttgataatttcctgtatccgggattatgtgatgtcggagttactacgtatgaagtggatatttcggagatggcgcggagagccgttcacaaaattgtccgcaaaattgcaaatgaaaactacacggcgggcgtgttcattgtagatggacatgtggtatttaaagatagtgtagctcggatatagaaaccggggcatcctgcttaaatgcaagtggggttgccccggtttcccgtttaaacagattgataaaatgattggtattatgaattcctaccttgcttccgatttcgtgtatggtgtcgttggtagtcagaagcagttttttagcctcttcaatccgcttatggtttaagtactggacaggagaagccccatagtatttagaaaactcgcggcagatccggtatttgctgacggaatacgtattttccagttcgtccagtgaataattttctccgtattgtgtgtcaaataaatgatgaatttcccacagataatccgggatcgtatcccggcgtgtggcaggatggccggaatagacagccatttccgtaagaatattggtgatccacatggagatccggcagacggacagaggatcattaaaagtgtctttctgcagattctgtaaatgctccatcgtatggaacagagtaaacatagaagaactctctgtcggataggcaagaggtgatgggagcagtgtgtgaaactgcaggagggcgagaccggaaatatacatatggaaatagtggcagtggccttttaagatttcgatcgtgaggggaccggaaatcggaagaagcgctgcgtgccggtctgccagccgacacgtatgatgttcatccgttacagaaagagtgccttcatatacatagaaaaaatgataaggcgcgttgatacggaatgtcatggaacaattgttcggaaaggaacagatgccttttccgagcagatgaataaagccgtcatccgctggtgcggacagcggaaaagccgtaaagtttttcatgttgtcagataatacatgctttggcaccgttcctgtaatcccatgatgctgtaattgttccataaaatcatcctctttcaatcataaccagtttttaattaagtataattggatgaaaggtaaaaagcaataatttaaaatgaaatataacttaaaattactttttggacaaaaatatatagacataatgcataaaaaagtaaatgtaaaattgtgcattatagggaatgtgtttgaaaacgcaatatgatatgattaaaagcaataaagagtgatgattaaattaacaaaaaatgtatacttaaattaacttaataattcacatgtttaaggaggagaacaacatgaaatttaaaaagtttatggcacttggtcttgtagctgcaatgaccgcaacattattcgcaggatgcggttctaagggaaatgattctgctgataccacacagaaatcagacagcgcttccgcagatggtcttgtaagctattcagacattgtattgggagaaacaggaaaagacttaagcgcaacaattacaatgttcaaccacagaacagatatggataccgatgattacggcggaaagaactggaaatcttatctggaagacttcaacaaagagtatccgaatatcaaggttgaaatcactacagatacaaactatgccgatgatgcactgacacatttacagtccggacagtacgaaaccattaccatgattccggcagtagataaggcagacctcagtacatattatatgtcatacggtacacttgatgagatgagccagcagatcaactacgcaaacacatggctctatggaaatgatgtatacggtgttccttccacagcaacgacacagggtatcgtttacaacaagaaagtgtttgaggatgccggtgtgaccgatactccaaagactccggacgagttcattgatgcattaaagaagatcaaggacaagacggatgcaattccgctttacacaaactatgcagcaggctggacaatgggtgcatgggatgcttatatcggaaacaatgcaactggtgacaatacatatttcaaccagaaactccttcatacaaaggatccattcaaggattatggcgatggcacacatccatatgcagtatacaagatcctttacgatgcagttgctggcggacttaccgaggatgactattctacaactgactgggaaggctctaagagcatgttaaacaacggacagatcggatgtatggtacttggatcatgggcttacccacagatggaagcagccggtgagaacgcagatgacatcggatatatgccattcccgatttctgtaaacggtgagcagtatgcatcagccggagcagattactcttacggtatcaacgtaaacgcttctgatgatgagaagcaggcagctttaatctttgttaagtggatgactgaaaagtctggattttcttacaacgaggatgggcttccggttgcaaagtcatcttctgatacaaagcttgatttctctggtgtgacattccttgaggatgaaccggctgtagaaggcgaagaggatcttttaaatgcattaaatgctgattcagaactgaacattaacaacggcggtaatgataagattcaggcaatcattgagcatgcggcaaatggcgatgagagctttgatgatattatgaacgagtggaaccagaaatggacagatgctcaggaatctgagggcgtagaaattacagagtagttccacgctgcataaaggtacatcatccagttgccgggccgaaaaactgttttcggcccggtggcatgattgcctgtttcatatgggaggaacgtagtatgaaatcaaaatcatttaattttaaaaaatgggcaaagagcagagccggccagcaggtattgatctgtatcggttttatgattatcccattgctcttactctttttattcacttattttccatttgcggaaatgatcaaatttagtttttataagatgaaatatacaacgccaatagacaggcgcgaatttgtcggatgggacaactatcttgatgtattcagaagaaaagattgtttcggggcgttgaaacttagtttattctatatggtcggtgcattgatccagcttgtgcttgcactgtatcttgcaacaattttaagctttaaggtaaagggtggaaatcttttcaaagggctgatgtttttcccttacctcatcagtggtattgccattggttttatctttaaattcttcttcaccagaggattcgtatttgatacaatcctgcagtggtgtgggtttcaattagaaaatcttccatactggttaaaggatcagagtgtaaacaactggtccctgacggcgacttccgtatggcggtataccggacagaatatggtactgtttattggtgccatgatgtctgtggatagcgaactctacgaagcagcgtccctggatggtgcaaataaatgggagcagtttaaacacattattctcccgagtatcaagacaattattacattaaatgttatcctttccatcaccggttccttaagtgcgtttgaggcgcctttcgtaatcaccaccggtgcaaacggaacaggaacgtatttcgtaattatgaacaagatcgcacataccagccagaaagtaggtctggcatcggcaatgtctgttgttctgctgatgatcatctttatctgtacgatcttacagaatgtgttctttaaatatgtgttcagggatgccgcgtcggaggatgaatcctataaggcaaagaaagcccggctgaaggcagaaaaacaggtgattaagcagatcaaaaaacaggagaaaatgaagaaaggagcggcgaaataatgagtagtacagcagcagtaaaacgtaaaaacatgaaacattattccgtaggaagcattatctggattattgtggaatatgcatcgctgatctttttcggattctgtgcaatcattccgattgtttcctgtatcacaacggcatttaagacagatgccgagtaccagaataccaatgttatggcatttccgggaagctggctgaattttgacaactttgtaaatgcatttaagacggcaaatatgggacgcgcatttttaaactctgtcatagttatggtggttgtgcttactgtatccgttattgtaggttcccagcttgcttacgtattgaatcgtttcaagttcccaggcaatgggtttatccgtaacctgtatacaattgccgcactgcttccggcagtagcaatgcaggttaccgtataccagattatgtcagatttacatcttgtaaacagtctgggcggttacatcattatgagctgtggtaccgatgttatttccatgtatattttcattcagtttatggaaaatattccgctttcactggatgagtcggcaattatcgatggcgcaaattactggcagatttactggaagattatgcttccactgttaaaaccggcaatcgttacatcctgtattttaaagggtgttggtgtgtacaacgaatactacgcagcaaacctttacctgatgagaaaagagatccgtaccatggcactttccctctacacattcgtaggaccaatgggaagcaagtacaatctgatctgtgcaggtgttattatctccctgcttccggcgctgatcgtatttgtctgctgccagaaacagatttacagtggaattacagcaggtgcggtaaagggttaatgattttggaaaataagaggtatcgggatgaataagagcatgatgaaagaagaagtcacaaagcatttgacggaaaatatcattcctttctggaaagcattaagggacgatacttacggtggatattatggatatatggactacaatttaaacgtagacaaaacagcagaaaagggatgtattttaaacagcagaatcacctggttttttgcgaatgcctacatactgctgaaagatgaaaccttgctggacgaggcaagacacggttatgagttcctgcgtgatcactgcatcgacaaagaaaatggtggaatcttctggtccatgacttatgacggaaagccacttgacacaacaaagcatacctacaatcaggcattctgcatctatgctctttcttcctattacgatgcatccggggatgaagaagcattaaagcttgccaaagaactgcagcttcttattgaaagcaaatgtacggatgaggttggatatctggaagcatttaccaaagacttccagccggaatccaatgagaagctatcggaaaatggtgtgcttgccgaaaaaaccatgaacacactgcttcatgtgtttgaggcttataccgagttttaccgggtttcccatgatgaagaggtgggagagcggttaaagtggattatggatgtatttgcagataaggtatacaatccgaaacttaagagacaggaagtattctttgacaagaactacaacaccatcattgatctgtattcttatggtcatgatattgagacagcatggctgatggaccgcggtgtggaagtgcttggggatgatcattacaaagaaaaaatgtcaccgattaccgagactcttgcagaaaatgtctacgaggttgcgtttgacggtcattctctggcaaatgaatgctgcaaaggggaagtgaatgaccaccggatctggtgggtacaggcagagactgtgatcggattcctgaatgaataccagaagcatccgcagaaaacgaagtttctggaggcatcggaggctgaatgggaatttatcaaagaacacgtcattgataagagaaccggttccgagtggttctgggaagtacatccggacggcagtccgattgcggaccgtccaatcgtagaaccttggaaatgtccgtatcataacggaagaatgtgtatggaagtaataaggagactttaaacaatgcatgaaagatattatgtagaactggcaaagcaggaaaagctgctttcacgtaaaaatgaaaaaagtgacttttataatggtgtatttgaccgttatgtgaatcccgttcttacaagagatatgattccgctcacctggagatatgacttaaacgaggagaccaatccattctttatggaacgtcttggaatcaatgcagtcatgaattccggagcaatttatttaaacggaaagtattatctggttgcccgtattgagggaaatgacagaaagtccttcttcggcgtggcagagagtgataacggaattgataatttccgtttctgggattacccgatccttctggatgatgtatgtccggaggagacaaacgtctatgatatgagactgacacagcatgaggacggatacatttacggagtattctgttctgagagcaaagataccagcgtgaacgatttgtctgcagccgttgcagcagcaggaattgtccgcacaaaagatttaaagcactgggagcgtctggaaaacttaaagacccttcgttccccgcagcagagaaatgtcgtgctgcatccggaatttgtggatggaaagtatgcattctatacccgtccgatggatgacttcattgataccggaagcggaagcggtattggattcggtctttgcgaggacatcacacatgcagtcattgacgaagagaagatgaccagcatccgtaagtaccataccattaccgaggcaaagaacggtgcaggtgctactccgatcaagactgaccgcggctggattcacattgcacacggtgtaagaaatactgcagcaggtctgcgctatgtgatctatgcatttgccacggatttaaacgatccgtctaaggtaattgcagagccatccggactgttaatcggaccaagaggtgaggagcgtgtcggagatgtatccaatgttgtatttaccaacggtgcaatcgtaaacgataagaacgaagtatttatttactatgcttcttctgatacaagaatgcatgtggcgactacaacgattgaccgtctgattgattatgtatttaatacaccacaggatccgggaagaagtgtactgtgtgtacagcagagatgcgacctgattaagaagaacttagagtatttaaaaaatcataaataagaggagagttgattatgagtgaagtaaagatgctgacagctccggtaccaaatgtaccatggcaggagagaccacaaggacctcagaacggagccccgatctggagatacagtgaaaacccgattatcggaagaaatccgttaaagggtgttgcaagaatttttaacagtgcggttatgccatatggtgatgctttcatcggtgtgttccgtggagagcagaccaatggtattccatatatttatcttggacacagcaaagatgccatccactgggattttgaagaaaacaagattccgtttgtggatgaaaacggcgagccgtttatgccaatctatgcatacgatccaagacttgtaaaagtagaagacacctattatatcatctggtgtcaggatttctacggagcagcaatcggcatggcaaaaacaacagatttcaagacgtttacacggattgagaatccgttcctcccattcaaccgcaatgccgtgctgttccctagaaagatcaatggaaacttcatgatgctttcccgtccttcagacagtggtcatacaccgtttggtgacatcttcttaagtgaaagcccggatctggtatactggggcaaacacagacatgtcatgggcaaaggaagcgaatggtgggagtccttaaagatcggcggcggagctgctccaatcgagacttccgaaggatggctgttattctatcatggggtatccggtacatgtaacggatatgtttattccatcggtggggcaatccttgacattgataatccttccatcgtgaagtaccgctgtgagaatttccttctgactccggaagagtggtatgaggagagaggtttcgttccgaacgtatgcttcccatgtgcaaccattcacgacagtgcatctggtaagatcgcgatctattatggtgcggcagacagctacgttggcctggcatttacaaaactggatgagattgtagattacataaaaacaaatagtgttgtaacacctgcagacactgaaatcggaaggagataactatgcatatttcaccggacgacaagagattacaatattgtggaagaattgattttgatgatccgaaagcaccggtgcttgtctatgcggcaagttttgtacagattcgttttaccggaacagaaatttccgtgacactggcaaacaagcgtgcttactggtcgagccggatgggatatatattagacggaaagcagggacagttcttactcacctcagattccgatgcaaaaacgtatgtgattgcagaaggtcttgagcctacagagcataccctcactctttttaaaagaatggattcctgccatatcgtcacattactgggatttgaattgggaagcgatgccgaggtacttactccggcaccgcttccgtcccgtaaaatcgaagttttcggggacagcgtttcctgcggtgaggtatcagaagctgtggattatgtaggaaaaccggacccggaacacgatggggaatattcaaacagttggtattcttatgcgtggatgaccgcgcggaatctgcatgcacagttgcatgacagttcacagggtggtatcgcccttcttgacaaaaccggctggtttatggagccggattatctgggaatagaatcctgttatgataaaatagaataccagccggaactcagtgaagtaaaaccatgggatttttcacgttatacaccagatgttgtgatttttgcattcgggcagaatgataaccacccggatgattatatggcagaagattataacagtgcacgttccgaaaactggcggcagcattaccgcagatttttagagcatcttatggaagtatatccgaaggcaacctttatattgacaaccacaatattggaacataacgaaaactgggacatttccattggggaagtgtgcaaaacaataaatagtccacgggtacaccatttcctgtattcacaaaatggaaaaggtacaccgggacatatccggattccagaggcagagcagatgagtaaggaacttaccgcattcatcgaaagcctcggagaggagatttgggatatgtaatcaatttttaaaaaaaattgattacattatataaggagtataacaatgcagattgaatatgaaagaggtatttccaatccgggcaatctgtaccggatgaaaaaattaatggcaagggcagaggccggggaaacattaaatattggtttccttggtggttcgatcacgcagggatgtcttgcatccgcaccggagctgtgttatgcttaccgcgtatttcagtggtgggagaaaacatttccgcaggcaaaatttcattatatcaatgccggaatcggtggaacaacatcacatttcgggacggcccgtgccgagtccgatctgctttcccataaaccggattttgttatcattgaattttcggtcaatgatgaatcgacggaatttttccgtgagacatatgaaggactggtacgccgtgtatggcaggatgaaaacgaacctgctgtgatgctggtgcacaatgtttattataataacggtggaaatgcgcagatcatgcacggtcagatagccagacattatcagcttccggcggtcagcatgcagagcagtatttatccggaggtcgttgcggggcggattccaaaccgcgagattacagaggatgatctacatccaaacgacaaagggcatgagctggttgcatctgtgattacctatgctttggataaaatccgcatggcacagacggatgatgaagagccggagtttcctgcaccgctgacacagaattgctatgagaaagcagttcggttggataatcgtaactatgagcctgaaaattacggctttgtcaaagataccagagtacaggaagaagtcaaagactgttttaagaacggctgggcggcaaaagaaaagggctcatctcttacatttacggtacagggaagtgagattgccgtgcagtttaagcgctgtgtgacgcagccggcaccggtggcgcttgccatcgttgatcacgatgaggcacatgcggtgacactggatgcaaattttgatgaggactggggcgattccctgacactcactccggttatggtacacggtgcaaacggtactcatacggtggaagtgcgtttgatctctggggatgagacaatgccagccgcatttgagctgatttctgtaatcacatcggaaaaataaaaggaggaatggaatgtttccaaaagattttgtctggggggtggcaagcagtgcctatcaggtagaaggaaccgacgcaaaagatggcaggggaaaaaatatctgggatgagtttgcacgctcgggcagagtatatgaacaccagaccgcagaggtttgctgcgatcatatgcatcggtaccgggaagattttgcactgatgcgtatgcttggcattaaaaactatcgattttccatcagctggtcgcggattcttccggagggaaccgggaaggtcaacgagaaagctgtgcagatgtatcgtgatatgattctttgcatgaaagaaaatggaattcgtccgtttattacgctgtttcactgggaatttccgtatgagctgtttaaaaaaggcggctggctgaacgatgaggtggtacagtggtttggtgaatatgcaaaagttgttgctgaaaatttctccgatctgtgcagtgattttatcacgatcaatgagccgcagtgtgcgattggactgggacacttaaatggggtacatgcaccgggaatgaaatattccattccggagacttttcagatggcacacaatctgatgaaagcacatggtcaggcagtcatcaatctgcgcaaatatgcaaaacagaagatacgggttggatatgctccgacttgtggcgttgcgtatccggcgacagagagtgccgatgatatcgcagcggcaaagaaagtgtactttggatttgaaaatccgatggataactggacttggaatgtggcatggttttccgatccggtatttttaggagagtatccgaaagaggggctggaaaagtttgcagactatcttccggagattaccgaagaagacatgcagctgattcatcagccacttgatttcatgggacagaatatttacaacggttacatgatccgctgtggagcagatggagacccggagtatgtggaccgtgcaccgggcacagcaaagacaggaaccggctggccggtgacaccggaggcactttactatggcatccgtttccttaccgagcgttacagactgccgctttatattacggaaaacgggatgtcggatcttgacaatatttccgcagacggacaggtgcacgacagagagaggattacgtttctggatgcatatcttggagcggtacagcgtgcgattaacgagggagtgccggtgatcggatatttcctctggacatttctggataactttgagtgggcagaaggttacaaagagcgttttggacttgtttatgtagactacacaacccagcgcagaattgcaaaagattctgcctactggtacagagaggtaatgaaaatgaatggagaaaatttaagctgtaaccagccatgtaaagaaattttgtttatgaatccggtatttacccacaacatctggggcggcaccaagctgcgtgaggagtttggctatgcgatcgagggcgatgacatcggagaatgctggggtatcgcagcacatccaaacggaacctgtacgattgcagacggtgcgtataagggaaagaaattatccgatctgtgggaggaacacagagaactctttggaaatacacaggggaaggtattcccgctgctgatcaagattattgatgcaaaggcggatttaagtattcaggtacatccggatgatacctatgctgcagagcatgaaaacggttctcttggcaagatggagtgctggtatatccttgactgtgagccggattccaagcttgttattggacacaatgcaaagacacacgaagaacttgaggatatggtgcataacggacgctggagtgagctgatccgcgaagttccggtaaagaaaggtgactttattcagattgatccgggtaccgtgcatgcgatcaaaggcggtatcaccatccttgaaacccagcagaatagtgatattacgtaccgtgtttatgattatgaccgtctttccaatgggaagccgcgtcagcttcacattcagcagagtctcgatgtcatcaaagttccggcagcaccgctttctgagtgcatgataaagaccggtgaggcagaggcaaacaaactgcagaagctgatcgagtgcaagtattatcaggtattccacatgaaagtcgaaggtcaggctgaatttgagcagtcttatccgttcctgatcgtcagcgtggtagaaggaaacggactcttaaaccataccagcgtgaagaagggagatcattttattcttccgtatgactacggtaaggttgagattgagggaaatctggaatttgttgcttctacggtttctacgaaataagactgggtaacggtttgtaaaggcatacatgatcctttgaggaatgtatgccttttttatgtgcaaaactttgtttgacaaagtaaaatatttatgtaaaataattataacagaatttatcaataaagaaatccatgaaaacattggaggaatcgtatggcaacaattaaagaaattgcagaaatcgtaggggtttcgagctcagcagtttcacgggtactcaattatgatgagggaatctctgttagtgatgagacaagagaggcgatctttgccacagcagagaaaatcggatacaaaaagagagtaatctatcccaagatcgaaaatgtggcattgctgtattttgttgaccacgaggatgaactcgaagatgtcttttaccacggggtaaaggatgagataataaagcaggcgaaaaagatgaatattcagctcagcatctatgaccgaaaagacggcatggatcatgttccgaaagatttaagtgcctttattgcgattggatggctcaccagaaaagaaatcaatgctttgtataaacggtgcaaaaggggcgtgtttatcggcacatccccggatgaaaaactttttgatgccgtgaagcccaatatggattcgtttgtgacacagatggttgattactttgtggaaaaaggacataaacggattggatttatcgggggcagtgatagaaatattgacaccggaaaaccttccatggatatccgggagtggtcatttcgacagagcgctgcatactatgggtatctcaatgaggagtacattttcatttccgagagatttacggtggatgatggctaccgcatgggaaaagaactgcttaaaaaagagatactgccaacagcactttgtgtggcaagtgacacactggcggtgggtgtgctacaggctttaaatgaaggcaatatacagattccggagcaggtggcggtttttagcatcaatgatgtgaatattgcaaagtatttatcaccaccccttactactattcatattgatattccatgtatctgtgaaaccgcgcttgatctgttgcgaaacagggtactatatggcggacgcgtaaccaagctggtgtttgtaaatggaattccagttttccggaagagttgttgaaaaaagatgttcgattgcgaacatctttttttgtgccttttttgtatatattgcataaaatacaaaaataaaaattggcaatatagtgaaaagtgtatttgtgagtattgacattattaggcttagatgatacattcttaataagtaaataatttacttgaatattagtaaagatttaattttagaaaagggggaacatttatgaaaaggaagttattacatgcagtccttgtagcgagcatggcagtagcattgtcaggatgtggaaacacatctggtattaatgctgatgcggagaaaacacaaaaagctacagaaacagagaacattgaagaggagagaggcacagaagttgctgccgcagaacagaaggaaaatacaacaggtacgccagatgaaaacggaaattatctgatcaacggaagttttgaagaaccagatttttccggatggacggtgacaaacaacaatgatgttacagaggagttagatgtttatgatcgtgagacagactgttttgcaggtgcacagtcactgcatttttattcaggaaacaatccggtggatttttccatgaaacagacagtgagtggacttgaggatggcacctacaaactaaccgctcatattcagggtgatgcagccggggatgaaaatccgaccgtatatttttatgcgctcgtggatggcgaagaggtaaaagcagatggcaaattgcaggggtatgttaactggtatacggtggaaatcccgggcattacaccaacggacggagcaatcacagtaggagcacacgtggcaacagcaccgggcggctggggaaccattgatgatattacacttgtgaaggagtagttatgaaatttattaagggtatggatatttccatggtgaaagaactggaacaatatggtgcgtcctatcggctgaacgggaaaaaagaagatctgtttgcaattttaaagacatgcggaaccaataacgtaaggattcggatttggccggatccctatgatgaaaacggaaattcttacgggggaggtggaaatgatctggagaccaccattgagatcgcagaaagaactgtacaaagcggtatggattttatgcttgatttccattatagtgatttctgggcagacccggccaaacaggtaaaaccgaaagcctggaaagaattaagcggagaggcactggaaacggcggtgtatctgcatactgtagatacgttaaaggcattgaaaaaccacaagcttgtgccgactatggtgcaggttggaaatgagattacaaaagggctgttgtggccggatggttacatcgaacagactgaaaatatggcacatcttctgaaggcagggattaagggggtgcgcgaggagtgtccggatgcaaggatcgtattgcatctggatttcggaacggataataaaatgtatcgacagtggtttgatcaggtttcatcgtatgcgctggattttgatattattggaatgtcgtattatccgcactggaacggaagtctttcacttcttctggataatatgaatgatatcagcagccggtatgacaaagatgtacttgttgcagagacttcgattggttatactacggaaacatttggctgcaacggaatcgtttattcgaaggagcatgaaaaaatcactggatacccggcaacacagcaggggcaggaagcattcttgcgggatttgtttgcaacggtaagaagtgtaaacaataaaagaggcatcggtgtgttttactgggaaccggcatggctgccaataccggactgtacgtgggcaagtaagagtggcagcaagtacatgaaagacaagatgacagcaggaaatgccatggcaaatatggcattgtttgacgaaaatggaaacgcaaacagcgcgctgataaacatgaaaacaatgtaaaggagggcaatcatatgaagaaaaaattaataacagctgtgctggctgtaacaatggcagtgggaatgttgactggctgtggaagtggaactggaaccggaaaaaaggaagcttctggggaaaaactcgtgatttggacgaatatgaacgtggaagtggataccattcagaaatatgcagatgaatggggagaaaagaacggacgaaaggtagaagtcattcaccagtctccatctgtccagcagtttgcacaggcagtaaaaagtgcttccggaccggatgctgtggtgggtattccaaatgaccagcttgcagattatgtaaacgcagatcttactgcagaagtgccgcaggatctgtatgaggataaggatttttccgatgcagccatccaggcatgttatgtagatggaaaacgatatgcagcaccactttccgtagagactactgcactgttttacaacacagatcttgtatcggaagtcccaaaaacatgggaagaactggtcgatcaggcagccgcagacggaggtgtacagtttgatgcaacaagcatatactacgatcttggttttgtgagagcctgcggaggttatatttttaaatatcaggatggggcatatgacacggcagacatcggtcttgataatgagggcagtgtggatgcctatgcctttatcaatgacctgtgcaataaatataaactgatcacggcagatgtgacagccgatatcgcaagaagtaatttccaaaacggaaaatgtgcttattatattggtggaccatgggacattgacggttttacctctgcaggaactaaatttgctgtagcaaaaatgccaactttccacggacagccgtttgtgaccccggtgggtacacaggtaagttttgtgagcaacagcagtaaaaatcaggatgcagcatgggattttatttcctatctgatggaaaacggtgcacttggcatgtatgaggcgggtgaccgtataccggcaaaactggcagatcaggaacttgatgagatccagagtaatgcatacacacaggcatttgtcgagcagatcaatgatggagagccgatgccgaccgtatcagaaatgggacagctctggagtatccacacaaacaatatccgttcgatgtggtctggggagcaaacaccagaggaagctgccaaaaatatggttacgcagttgaaagaagcgattgaattgatgaattcaggaaagtagtgatggcatgagaaagaaaaagaatgcgcttgggtatacttatctggcaccggcactgatctcgattctgttggtgacatgtctgccaattatttatacggtgattttatcttttactaattacaacatgtatcatctgacagattacacgtttgtgggtctggaaaattatctgaccgtattttccggaagtattaaaaatgtgtttttcccggtacttgggtggacgatttgttttgcgctgttaagtacggcaggttcctatgtaatgggactgattcttgccattttgttaaacaatccgcatatgaaagaatcaaaaatttaccgtgcagtgctgattgttccgtgggcattgccatctacgattgcaatcctcgcatggcagggactgctaaatgagcagtatggtggaatcaataatttactgcatacaatcggtattgcctggaatgtaccgtggctgaccaatccattctgggcaagggctgggctgattatcgtgaatgtgtggctgggatttccctatatgatgaatgtctgtcttggtggactacaggcgatttctggtgaatactatgaggcggctaaaatggatggggcatcaaaatttcagtgctttaagagcattacattgccgatggtgacaaaactttccattcctcttgtaatttcctcgtttgcggctaattttaacaattttggaaatatatatatgattacacaaggtggaccagcgagagtggataaccagtttgcgggttatacggatatccttgccagtaccacctataagatgaccacatggtcgaaccggtatgaactgtctgcaacgttcagtgtgctgatctttatcattgtcggaacatttacgctgattaatatgcggctgtccggctcatttaaggaggttgattaaatgaaaaataaaaagaaaatatccgcctcagaacaacggacactgtggggaagcagagtggtcatatggatcacaatgatcgtggtgctgtttccggtcatatggattgttatgtcctctttttccgcgggtgacagctttttcctgtcctcattgttccctgaaaaattcagcattgaacattatgtggaactgtttcgggaaacggattttggaatctgggtttttaattccctaaagttttgctttattgtagcaatcatacaacttgtgcttacttcacttgcagcgtatgcgtttgcaagactgcggtttgtgggaagaaaatatggactgatggcacttttgatattacaggtgtttccaaacagcatggcagttgccggatactatattttaatttataagttcgggctggtggacaacagctttgcgctcattcttgtgcttgcaggtggaagtgcttacaatatctggttacttaaatcttatatcgatggacttccggtggaattggatgaagctgcaatggtggatggagcaaatgaattccaggttttttataagatcatcatcccgcttgcaatgccacagcttgccgtgatcttcctgttttcgtttattgcaacatacagtgaatatgtgattacctcaatctttttgcagacaccgggaaaaatgacgcttgcactcggactgcagtcttttatcagcgatcagtttgctgcgcactggactttgtttgctgcagcagcagtgatttcatccctgccgatcatgatcatctttatgtgcttacagcgatttattcagaatggattggttgccggaggggtaaaaggataaaatgaaatatcatcggggattcttcatgaagatggcaaaatagggacgaatgaggatttttccggattagcgggtcttttagaatctgcaatttctggagtacgtgcttctgctgcatcaagtaccaaaattatgcttcatctggatcagggtggaaaaaatcagttgtatacctggtattttggtggattattgaaagagtcaccaaacttggattttgatgtatttggattatcttattatccaatgtggcatggaaccatggaggggcttcagtataatttgaattacttggcgaccacctataataaagaagtgtgtgttgtagaaactgcgtatgcatggacaacggaagatggtgatggtgaaggaaatgtattcattagtggagatgaagaagttggaggatatcctgcaacagtagaaggacaatttgaatttatgaatgatctggaatcaatcattttaaatgtaccagatgacaaaggtattggatatttttattgggaaccagaatggatacctgtagaaggcggaacatatgctacatctgcaggggttgcgtataaaaatgataccgtaacgccaagtaatacatgggataacatgacgttgtttaattttcagggaaatgcattagattctattaaggtgcttaataaaccgtgtgaaaatttattgacaaatatcagttttgaacagaatgggataactacttcaccgagtggatggaatgtatggacaagtgattcgtcagatgaaaatactgtaagaacagaatatggtgatgcatatgatggagattacaaattaacattttgggatgataaagagtattcgtgttctgtatataaaacgtatacaaatattccgaatggaacatataaattctcaatttgggcaaagacaaatgggaaacaggatgttttacaactttatgcaaaaaattatggaggaagtgagcttgataccacgattgaaacaagtgacattaattggaatatttttagtatagacaagattgttgttacaaatcatacgttggagatcggggtttattctgtagcaggagcaaatgactggtgtaaccttgacttggcaatgttaagaaaaattgattaattatatttaaaatttttaaggggatggttttgatcgtccccttaatttttgaattgttctttgactggtggaatcttatgaaaaagaaaatatggaataggtgcagaaaaaatggtacgttatgataagattttttctatcattgatattaaagaagaaaatatgaaaaagtgggggaagtgcttccattttataagaatgtacaaaaagagggggttattctttggaaggcagcttaaaagaactagcacgatattagcacctgtagagcagaacataatctgttttacaggtgcttttttcaattaataaggaactggtactttcgtctcttgtgaaaatgtctaattaaaagactaaaaaaagactaaaaaactttaaattaagtaatactttacaaacgattaattttctattaactaaatattgacttaaaattactttgtgatatactgaatttatcaaataaattaagcaattgcacactggttcccatattttttactgcactccccaagtatgcagtaccctctccctgaaatatgggaagcagcgtgcaattgcttttttattaagtgaaaccggatagatggagggtgctggaaggtttttacaactaaaatggagaagaaaggaaaggtagagcaaaaacatgagaagggtaggaaaacagattgttgccatcacgctggcagcggcaatgatggggtcactgacaccggaggcatgcacatttttacagaatgagattgtgtatgcggcggaaacaaatgaagcgtcagcaccaacagtaacacgtacagaactgtacaaaaatgagaacgcaaaaacaacagaaaccattgatttttcaggattgcaagaagaagactggaatggtgcaggaaaaattacttttgcatatgataattccatcaatggctcgtcgggaaatgtgaatgaagagtatgaattaactgcaaaggtaacactggatgaaacatcctatcagtcgctggatgcagataaagcgcatctgaatatccagggtgtaacaaaactgggatcaaaatggggatggaacaacagtacggattgccagtggctgcagaaggattcttttatgaaagttggggagaattattcagctgatctgaaagtaaagttttcaggaataacaccggatacattgatggatgttgaattcgttcttgtgggaaccggatttaagggaactgtgacattttcaaatgtagttctcacaaatttatcaagcgataaacaggaactgaccaaacaggagccaaccgttctttctgatttaaatgatgaatcccaggtaaatctgtgggtaggtgaaaccggatatcagtatttccacggtggaacaaaaaatgctgctccggaactttcctatgacgcaaatggcggagacggaagattaaaagtaagcctgaattatacagccaactccggcgaatcatggagtgaggcaaaagtgaaattcacaccgaagacaccggctgatatcagcaattataatcaggtgagtgtggatttgatttatccggaaagcagtaatatttccaagataaaatttttctccaatagcgggatcaataaagataccagcatagattcgtccgaggcagcagatgcaggaaacggatataagaaagttacagttactttaggattttctccatctgccacaccaatggatgatctgacaatcggacttatcggagccaacagttcctttgcaggggatgtttatctggataatctgatactttcccagaaggatgccagtggtgattttgtgacaattaccgcaacaccgaatacagacggaacacaggcaaaaccagaagcaacagataaaaccctgaccatgacagatccggatgccagcaatagcgcaaaggcattgtatgcatatttacagggactgaccgagagcgatcaggtactgtttggtcatcagaatgatgtcagccgttcggttggaacaaaggatgagttaggagatgtccatgatgtgaccggttctgtcagcggtatttttggaatagattcccttgcactgtttggaagcgaggcaggtggaacagatgcaaaatctgcactggaaaattccatcaattacagcaaaaaggcagcagagaatggagcaatcgtcacattatctgcacatatgccaaacttcacaagcgcgaagatcaaagacaatggggatggaacctacgatttctttgactgtaatttcaacgaatccaaagatctgtccggggacagcttaaagaagattctgccagaaggagaaaagaataaggtctttacggcttatctggataccattgcaacctatgcgaataaattacaggaatcaaatattccggtcatcttccgtccactgcatgagaataccggcggatggttctggtggggaactggaaacacggcggaaagttataagagtctgtatgcatataccagagagtatctggaatccaaaggggtacataatatgctttatgtgtattcaccaaacggaccgctggagaccgaggcagagtatatgtcgcgttatccgggagatgcctatgtagatattctggcatttgactattacaacgattttaatacctatccggctgaagcagatacgtcgttctttgatcatctggatcagacctgtcaggttgtatcatcacttgcaaaacagcataacaagctggctgcaatttcggagaccggtgtacgtgtgatgaagaaggatggaagtgataacgaagggcttcttgtaaaaaataatccggtcagtgaggcaaagtcgggtgtgaactggtatcagaaagtgaatgatatcgcaaagaaaaacgacatgccatattatatggtatgggcaaatttcagcgataccaatttctatgtgccgtataaatacagtgataccatgggtcaggaaatgatcaatgagtttattgattactataacaatgaggattcagtatttggaaacggtactaatttctatggcaatatcgataagtatgcaggagtaaagaccgagaaatacaaagatgtcagcggatacatggtagcaccgtttgatatggatacgattttaaagccaactgcattaaaggcaagtgtttccaatgccggtgaggtatcgtttgttgtaaaggatacggcaaagggcaaacagttgacattgccggctgcaaaaggctccgacggattctatacggcgcagctgacacaaaaggaaatggatcagatcggaaaaacagatgtagcatccattacacttgttgcagatggaaaagaactgtccacgatcacaaatctgagtatcggaaaagaaaaggacaaagctccggcaggtgtgctggaaaattttgactactatgtcgggagtaatggacttctggatgcagcttacggtggaaattctgccgctggatgcagttcgtcctttacgctggatcaggagcataaggcagacggtacatatggtgctgcatttcattacaaattaaaaacaaccggttcggaagtctggacgggtctggtaaatgcaagtctgggcaatacagatttttcagcctataatgcattgaaattctggacaaaacttgatggaaaagggcagaaggttgttgtacagatcaaggcaggaggagaagagtatgaagtatatctgaccaatcttgcgaagacagaagatgcctatgaagtaaccgttccattctccgcttttaaagggaagacgggtggaaaacttagtggggatgctttaaaagatgtgcaggcattcggactctggtgtaattccaacccggcaggttccgcggtagatgtggaatcggtactttactttgatgcattcaaaggaacaacgatcagtgatgcagaagctgcaaaagcagatgccgatggcctgattgcggtaaaacagaccagccagagtggaaataatggcggaaattcttcctccggcagcagcacctctggtggaaattccggcagcacaacaacaccggatacaaaaccatcagaaacccggaaaacggacaaaacatttgagaatattgcaaaagatacaaatgcgacacttaccgttgaaaagaacgataagggagaagtgacagatgcccgggcacagctggaaaaaacagtaaagaatacttccgagacaaagaagactacaatttcagcagatgtggttgcaaaattagtcaaagaggcaggaaccagcgacattacgattacccagacaacgaagaacgcttccggcaaagagatgaacagcgtatctgtcaatgcgaaggatctgcaggcaggcaaaaagctgacacttgtaaaagttgataaaaagacaggagaaaaagtcctgatcagcagcaggacttataaggtttccaaagacggaacggtgacagtggataccaaagatgccggtgattatgtactgctgaatgagaaggatgcaaaggctctgagcagtaaaatcttaaagagtgttgcattaaaggataccaagaaaacggttgcaaacggaaagaaggcaaaagttacttttgataagaacctgaacatggaaaatgtaaagaagatcacttatacatcttccaaaaaggcggttgtaacagtgaataaaaatggtacaattgtcgcaaagaaagctggcaaagcagttgtgaaagtaaaagtcactttaaagaacggaaagacaaagactgtaaagatgacgatcaaagtgacaaagtaaatttacaggagtctcgtcagaattttaataagaaaaagacggtttcgcaggaaatcgtcttttttcttacccataattgtaaagagaagcgtgtgcgttttttcgggggaattgattgtaatttcaggaacctttgtttatactaaaatcaatagaaaagagaatgagaaggagaacatttattatggcaggaaaacacatttccattccggcacttttaaagatcggtgcgggtgcattggacaatctggggatttacttaaaagagttacagttacagaaagtagttgtattgtttggaaacggtcttgtagaaatgtttggttctaccgttatggaagcattgcagcaggaggacattgatattttagaatatcaggaacttgataccgtgcggttggaagatctgaccagtcttgcattttccatgccggcgaagacgcaggcagtcatcggcatcggtggcggaaaagtgattgatggtgcgaaatattgtggatttctgcgaaatctgccgtttatcagcatcccgacatcggcatcgagcgatggcttttcaagtgccagtgcttcccttctggtggaaggacgccgcaagtccgttccggcaaaacttgcatatgggattgtggtggatacaaggattatccgcagtgcaccggagaaatttttatattccggaatcggcgatatggtatcaaaaattacggcactgtatgactggatttttgaggaagaacatgggtacggaaaagtcaatgattttgctgtcatgattgcaaagaaagcagtcaacagttttgtgcgcacaccgtttacttcgatacaggatgatctgtttttaaaggaacttctggattctcttgcaatgagcggaattgcaaatgagattgcgggcagcagtgcgccaacgagcggcagcgaacatctgatttcccatgcgctggacaagatgcttgagcatccgcagcttcatggtattcaggttggcattgcaacctatctgatgagtgttgtgcaggatcatcgctaccgcagggtagacacgatttttacgcagacggggttctgggattatgtaaaaacactggatcttcggcgggaggattttgagaaagcagttgatctggcaccgtcgatcaagccgttccgctatacgtatctgcatgagcagcagtaccgggatcgcgcgaaggaactcctgcatacagatgcgcggctgcaggaaatcctgaaatagagaggaaaataaattacaggatatacaatgataaaagtagcaaaatctgttggacaatgcaattgaggcaatggggcagataaaagatcgttttttggagattcggatacaatatgacaggggaagacattggagttttttgttggtttaactgcacataaggacagtgttatatatgcgaaagtaggatggtaaaatacaggatgtatttggaggattatgaatgaagagaatcagtttgtacttattaatttttacaatgctatattgtctgtgtgcgtgtggaaaaaattttgatgcaaaatcaaacagtagagaagatgatggcagaaaagaacaaaagataatcatatcatcaattcaggttgcttcaaatacgaaggttatgcgtgcaaaggtgttccttccgaacgcaaaatctttggaaggaacaaattattggttaggtgggttagatactaccagtaaggtggatgtaatagatacaggtgatggtattcagatcaatgtgtgcggcttttattccgatgatactgcgtggaaaaatccgaaagtatataagggatttcaatcaccggataattcaaatacgccattaaaaaatgttttggttaagggaaaagttgttccaatgaaggagaagatgttaaaagcggatgttaagaaaacaaaaaaaacaatccctgttgaaattacaccttatacggttagtatttgtcccgtcaatgactggagagaaaaagggtgtttttatcatgtagttgcaacaacaaaagacggaaagcaatattccataggagagttacctcttaccgatgacagaaaaggaactgaaaaaaagaaatatcctttcatggatggtacagatcttgaagagcttggagatggctatgcatctgcaagtgaaatgaaatattgtggggctcgttatattttcaatcagaagattgatatcacacagatagaacagatagaaataataaaatataaaatcagcagatgatataggtataaaaacaggtcataaatttgttgacgatgattggaaaccatgttaggatgatggtagagactatcaatgaagtgacaggggaatgagtttttgactcatccccctgttcttattatcaggagaaatggatgaaaaagaacaatcagatgaaaccagacaatgtagtaaaacgtctatgggcattttttatcgtgctcaccatgtgtattaccgtgcagcctgtcgtgccggtaaaggcgcaggaggctgtgcagacagcggcaagaacgatctatacggaatttaaagatggaaattctacccattccggagatggaagctatggaaatccctacaatttaattgaggatgcctatgcggctgccggcaatggggatgaaatctcaattttgggaagtggtgcttttttaaatgccgaggctgcggaaccgtttatttttgataaaagcgtgaccgtcaacggaaatggaaatactttttccaaccgtaaggggggatttatcctgaatacggatgtgacatttaaaaacattacgctgcggttttccaatcgtctgcacgatgcaatttttgcaaatgggcataaacttgttcttgagaatgttacgtgcgacagcggattccgctatgtagatatctttggcggatccctttatgagaatggaaagaatatggggaatcatccgggatcagaggcacagattctgattacgggtggtggtaccaatctggggaatatttatgccggttccatgaacggaacatatgacggtaagacacagatcgtgcttgcgcacgtttccggtacgcaaaatggggaaatctatgcatccggtgccattgaaccatatgtaaatcaggatgactggttttccacgcaggagccggatccaccggcagcggatggacaatatacggtttccggcgatgtggaaatttcacttaccggttccgacacgaaacaggtgtacggagtatctgaaaatcacgcagggaagacatttctgaccatagataccgaccagtcctataccggaattccaggtataagcaaagtaggaaacctcacagtaaagggcggtggaacatttgcaccggcagcgttggacagctgtacggtcaggctggaaggggcaagtgcgattgatctttcccagatggaaactccacaggtacattcgattgtgagtgcggattcagcaggaaaccgactgatcttaggaaaagaacagacgctgaatgttacagataccattacgggtgcacttacatttgaaaccttaaatggaagaaatggaaaatccggaattgcggagtataatcacacctatctggaacttggaagggctgcggatacggcggtttcttttacaccgacagacggacagacgggaatgacactggaacggacatcgtctggaaacggagaaatctggaaaaccagtgagttgtcagggaatgaaccggaaccggttgcagtaaaaaatatgaccataaaaaatccggtaattaccacaacggtttcagagatttctggaggtagaaagtcatatctggcagacgtgagctggccggatgaaacagatgagacatataaagagttaatctatgttccgttacaatatgaagtgacatttaatgggaaaacactttcttcagagacggttacgaatgatgaaggtagttttatttgtattccggattttaatttgatgttcgaaacgggaatagaggagaatgcgatcacactaatgtgctatcgcacggctaatagttctacggtaaaaccgggaacctaccatatcacaatccgtccattttcagcaggtgaacaaattgagcagaaggtagttctgattgtaaacaaagatccggatacatccggttcgacggttacttcaaaggaaacaaccactacgataaatggattaccatcggccgtgtccatgcaggatgaactgaatcttaccgtgcagacggtctatacagatagcagcttacaggaacagaacgtgccgtctgctggtttttcggtatacattaaccagaccccttatgaagtatccggcatcacgcttcaaaacggagtggcagccataaagattccggtttcagaggcaaacggatttcatatgggagaaaatgcaattacagtttcttatgcaggagcagtcgataaaaactacagggcacttccttcccaggcaaacaaaaccgtgacggtaaatccaattgccgtaaagatgcagtatgataccatccagcagacagctgcatacacagggctgaaacagagctgctttgtttccacggtaaatgtagtccgaaaggacaacggaaagacggtagattcgcaggtaaagcctgaagttttctatcggcaggatgggaaaaatgttgttccggtgcagccgggcagctatgaggtgtggtttaaagtaactggaaaccagtacgatgtgatagaggaaaaagtcggaacctttaccattacagcggcgaaaccatcgattcgccttacggcagagacagaaaacggtaattccgtacatctgtatgcaaaggtagatggagtccgaaatggcagtattccgcttggttcgatttctttttatcaggacggaaccataataaaggcacaggaaaaactcgtatatggggaagccgatacggttgtatcaggcttaaaacgtggcggttcttatcagtttaaggcagtatatgagccggatgataaggatggacagacttattacgaaacagtgacaagtgaagccgcgaccgttacaatcaaagaggacagttccaccggaggaagtggaacaaccggaggcggctcatcttccggaggcgatggaacaaccggaggcggctcatccaccggaggcggtggaacaaccggaggcggctcatcttccggaggaagtggaacgaccggaggcggctcatcttccggaggtggtggcggaaatacttcgagtggtgacacagccggagggggaacaccatccaacggaaacaaaaccgatgcagaaacaccgtctaacggaaatacagctggtacagaaacaccgtccgatggaaacgcggccggacaaaatacaccaaccgtgaccgttaccggaacccagaaaaataaagccatcaaaacaacggtgaccgctgatctgataaaacaaaccatggaagaaaataatggaaaacacacagatgtgacgatccgggtcaccgatccggctggcaacgtaagctatacactgaccgtaaatacagcagacatacagaccggaaataagctgtatgtgtgtgcaaaagatcaaaagacaggtgcctatgtccttgtaaacgacaagagttatacggttacaaaagccggaaatgtgaatttttcagcagattccaataaggattatgtccttatggatcagaaagatatggatcaggtcacaacgaaaatattaaaaacggttacattgaagaataaaaccgttcaggtgaagaagggaaaacaaaagaaggtttctctggcagccaccttaaatatggacaatgtaaaaagcatttcttatcagagcaataacaaaaaaattgcatctgtaaacaagaagggtaccataaaatcgaacaaaaaaggaactgcgtccattcgcgtgacagtaaccttaaacaatggaaagaccaaagttttaaaattaaaagtcaaagtcaaatagcagatgcaggaaaagacaaaaccccggaaataaatatccggggtttttgttttacctagagagaaagtgcacactgatcaattttttccaattcttcctccgtaaacggagcagagtttaacactttcagattttcaagaatctgtgccgggcgggaagctccgatcagaacggaagtgaccacaccgtcacggatgacccatttgagtgccatctgtgcgaggctttcaccacgggcagccgcaatctcattcagactccggatactgttcagccgcttttcatcgaactggtcggcatgcagaaaacgtccgtcggtattgacacggctgtcctttggaatgccgtgcagataacggtcggtcagcataccctgtgcgagcgggctgaaagaaataattcctttcttcccatctgctgcggcctgttttaaaccgttttcttcaatggtacggttaaagatattgtaggaattctggttgataataaacgggcagtgcagatcttctaagatggcagctgcgcgtttcatggtttctccatcgtagttggacagaccgacatacagtgcttttccgcttcgcacgatctggtcgagtgcacccatggtttcttccagcggcgtatccggatccatgcggtggtgatagaaaatatctacatagtccagaccgagccgttttaagctctggtcaaggctggcaatcaggtacttgcggctgccccagtttccataaggccccggccacatgtcaaaaccggctttggaactgatgatcagttcatcgcggtaggaagaaagttcttcccgaaggatcttcccgagattttcctccgcactgcccggctgcggtccatagttgtttgccagatcaaaatgtgtgatcccgtggtcaaatgccgtaaagcacatctgtctcatattttcataaacaccggtatctccgaaattgtgccagaagcccaaagatacttccggcagcatcagtccgctgtcgccgcagcggtggtatttcatggtttcgtaacgtgattcatttgcgtgatacataagaaatcctccttagtttgtaaaaaatttatcataaatgccaaatccaaagataaaaagcacaatcagcggcagaatataggtaatgtagccgcgcatccagtttttaatttttaatccttttccggtattggcttcggttgtgtagtttttccagccccagccgtagcggcttgtgcaaaacagcagatataccagggaaccgagaggcaggaacaggttgcttaccagaaaatcttccaggtcaagcacagacccgccaaagattgaaaaacctttccagttccatacattgtatccgagtacacatggcagggagagtacaatgatcagtaccagattaacggcacaggatttctggcggctgcatccggtcagttccataccgcaggagatgatgttctcaaatactgccaggattgtggaaaacgctgcaaaaaacataaacaaaaagaacaggcttccccagagtctgccaagcggaatatggttaaaaatattcggcagggtgataaaaatcaggcttggtccggaagtctggtcaacatggaacgtaaagcatgccggaaaaatgataagtccggaggtgatagcaacaaacgtatccagaatggcaatatttaccgattcaccaagcagagagcgttcctttccgatataacttccccaaattgccatcgcgccgattccaaggcttaacgtgaaaaatgcctggttcatggcacccgtaatggtttttgcaataccgatctgtttcatccgttcaaagtccgggatcagataaaaggcaaggccttcttttgcaccatccataaaaaagctgttgaccgccagaatgatcatgatgataagcaaagaagtcatcatgacctttgttactttttccagaccgttctgcagtccacgggagcagacaaatacgccggcgcaaacaactaccaccatccagaagcccatggtcagaggtttgctcagcattgtggtaaactgtccggatacaccgtcggcatccagtccctgaaactgtccggtgaccgtcatataaaaataatgaagcatccagccggtgaccgttgtataaaacatcataagaagatagcagccgatcaatgtgataatcccgtggatatgccatttctgtccgggtttttccagtgcctggtaggctttgaccggacttttctggctggcacgcccaaccgcaaattccatcgtcatgatcgggagtccgagaataatcagaaacaacagataaaacagcacaaaggcaccgcctccgccctgtccggcagtgtatggaaatttccatacgtttccgattccgatcgcacatccggctgacaggagaatgaatcccagacgggattttaatttttctcgttcttccataaaataatccacctttttgtaaacattgtataaaatacaaacgaaattatacaatctgttgtgagaagtttcaaccctttttgacgaaattttaccaggtatgtgttgcatttttttacagatactagaggagaaggttgcggagtgttcatgttctgcaatcaacaagattatcttatggaaagaaagaggtataaaccatggttttaacagaaaaagagatggctacaattgaggatctgcacacacaggagctgtcctgcgtggagaagtacaaacgttacggacaggaagcaaaggacccggtgcttcgggatttgtttgccgatctggaaaaaaaggagcaaaagcatgtggagtctctggaacaggtcatgaaaggcagtgtcccgtcctgcaacgtcaatgacagggatggaaagatgtatgagccaaaggcaacatatgattccatgaccaatccggaagataagaaaaacgataatttccttgctacagacagcattggttctgaaaaaatggtgtccggaacgtataataccgatgtgtttgcattcggggattccgatgtgcgcaaacttctggcagatatccaggtggaagaacaaaaccacgcggagatgctctataaatataaaaccgtaaacggcatggcatagccggcatgtggagtggatgtcccaaagcatccactctttttgtttttacaaaaggattacagaaaccggatagtacatcttacataacctgtttatcataaatcctgtaataaatcttacagatttcacaaggagaacatatgtctcgatggcggtgataagtgggacatagttggaaaaatatatcatatatgtcccaacacacgatgcaagtgggacataatcaatcttttattttctatatgtccactatcaatttggaaagtgatagaacacttgattttcttaaaaaacacatgcaaatcggtttgttaaaaaatggtctggaaaattcaatttcgaaacaatcccagcgtattaaaaatatattgacatttacgaactttacgctataatagaatcaaacatatgaacaaatgctcatatgaaagaatgataaaatgaaaaaggaaagtatggaggaaaccgacgatgaagaaaacttacaaaattgatgtggattgtgcaaactgtgcaaataaaatggaggaagctgcaaaagctactaccggagtaaaggatgcaactgtaaatttcatgacactgaagatgaacgtagaatttgaagagggtgcagatgcaaaagcggttatgcaggatgtgttaaagaattgtaagaaagtggaagatgattgtgagatctttctttaaatccggctttttccataggtatcagtcagattggaggacaccatgaataaaaagcagaaaaaagtattgaaacgaattattgtggcagcagtgcttctggttatcatcgggattgcaggaagcgttgtttccataccaaagtggctggagtttcttttctatctggttccgtattttgtgatcggttatgatattctgcggaaagcctggaagggaatctgcaacaggcagatgtttgatgaaaattttctgatggcagtggcaaccatcggagcgatcgccctcggtgattacaaagagggcgttgcagttatgctgttttatcagatcggagagctgttccagagttatgcagtcggtaagagccgccggaatatcagtgatctgatggatatccggccggattatgcaaatattgaaacagacggtcagatggaaaaagtagacccggatgaggtggagatcggcacggtgattattgtacagccgggcgaaaaagttccaatcgatggtgtggttgtggaaggacattcttccctgaataccagtgcactgacgggagagagtgttccgcgggaagtcgctgtgggagaggaaatcatcagtggatgtatcaatatttccggactgttaaagatccgcaccacaaaagagtttggagagtctacggtttctaagattcttgatctggtggagaatgcaagttccaagaaatcacgttccgagaattttatttccagatttgcacattattatacaccggcagtctgctacggcgcgctggcactggcaatactgccaccgcttgtccgcatgctgtttatggggcttccggcagactggggcatctggatttaccgtgcactgacatttctggttatcagctgcccgtgtgcgctggtcatcagtattccactcagcttttttgcaggaatcggaggtgccagtgcagagggtgttctggtaaagggttccaactatctggaagcacttgcgggaacgcgtacggttgtctttgataagacaggaaccattacgcagggggtatttgaagtctgcggaattcatggaacaaattgtgcatccggcagctgtccggttgagtccggacatccggtatatacgaaagaggaagaacagctgctggagtatgcggcactggcagagtgtcacagcacacatccgatcagtatcagcctgcagaaagcctatggtaagaaactggatgtggaccgggtcacagatgtacaggaaatcggtggacatggtgtgatcgcaacggtagacggacacagggttgcggcaggaaatgacaaactcatgaaaaaagaaaaaattgcgtatcgcaactgcagctgtaccggtacaatcgtacatctggcagtcgatggtgtctatgccggccatatactgatttcagatatgattaagccgaatgcggcggctgccatgcaggcactgaaaaattccggcgtgcaccggctggtaatgctgaccggtgatgatgaccgtgtggcacagcaggtagcaggggaggttggaatcacggaagtacattcccagctgcttccggcagataaagtttccgaagtggaaaaactgttgcagaccagggaagaaaagagtaccgttgcctttgtcggggatggcatcaatgatgcacctgtgctttcccgtgttgatgttggaatcgctatgggagcacttggatcggatgcggcgattgaggcagcagatgtggtactgatggatgatgatccgctcaagattgcgaaagcaatccgtatcgcaagaaagtgcctgcggattgtatatgaaaatatctgttttgcaatcgggattaaactgctctgcctgtttttggtaacgataggtattgcaaatatgtggatgggaatttttgcagatgtcggtgttatggtgattgctgtgctgaatgcaatccgcgcactttttgtaaaaaaattatagggtataattctgccggaaatgttccggtggagaggaggaacttcatggaaaaagaaaagattgaatgctgtagtgaaaatcaggtacatccggatctgctaaagatcgtgaatgacacgatgccggaagaaacggaactgtatgatcttgcagaattatttaaagtgtttggagattccacccgtatccgcatcctgtttgtcctgtttgaagcagaggtgtgtgtctgcgatcttgcagcggcattgtcaatgacacagtctgcaatttcccaccagcttcggattttaaaacagaataagttagtcaaatgccgcagggagggaaaatctgttttttattccctggcagatgaccacgtccggtcaatcattgcacagggcagggagcatattgaggaagatgtaatataaggatgataccatatgggagaaaaggacattcgcggtggatgtccttttttcgtacagacggatcttaatatttatttaagtttctttaaagatagccttttttggatatgaaactgctataataaaggtgcagtagaaaaaatacatcaattaaaatatgaggtaaatacatatggaaacttatgaaagcgtaaaaagtaatccggtgcagccggagcagaaagaaaagaaaaaaggcggtgcatggaaagggattgtagcggtgattcttgcggcaggcgttgtgggaagtaccacgatttctgcgtttaatctggtgactctaaaatcctatattgcagagcagaaaaaggaagaaaatcctgagactaccgaggattacgtaaagatcgcagataattatgagatcaaacctaccacaaatatttcggatgcctacaaatccggcgatacttcaaagctgacagacaaagaaaaagaaacccttgatatggcaaaaaaagcgatcaaagatatgaagattacggacagcatgtctgattttgaaaaggaaaaggcggtgtatgactggatgaccaaaaagctccagcaggattccggggcactgaccgttattccgagtacacaggaagactgtgataatccatacggtgtgttaaaataccacaatgccgtatgtgtcggttatgcgacgacattccgcatgttcatgcagatgatgggaattgaatgtaaagtggaacataatacagaaaaattccatagctgggatgtggtaaaaattgacggagactggtacattaccgatatttattccgatgcaggaaatggaaattatgcgaactttaatgtgacggatgccatgtatggacagtcccagagctgggatcgcgattacttcccggcagctaactcattaaagtacaatatggcataccagaataagaaaaccgtggacagtatatatgatctgccgaaagcattgcgtgctgctatggacaaaaagcttggcggggtcatggttgcgtttaaagaggatattacagaggaaaaagcgcaggtggcaaatgccatagcttcttccattgacaatttcctgatgtccggaaactataaggatatgccatacagtctgggaacttacaactggattcaggatccggatggaaaaggatatttgtttaatgttaccatgccgggatataacacggacaatacaagccagaatatcagcgaaaaagaacagaaaaaaatcgacaaggctgtccagaaagcatttcagggactggaatctgcaaacggagatggcatgatgatggatggcgcaagtgctgatatcggaaataaggatatgaccatggatgatgcggcacaaaatggggcaacgttcagtacggaagaaactgtggaggccagataacagatgaaaaaacaaaaaacgggttggaaacttctgctgatgctgaccatgctggtgatgtgtgtgggatgtggtgcgaagaaaaacacttccggttctgtcagtatgtatgacctgcgcacggcgatggaagcagcggatccggatctgccggagatgctcaatgccagcagcgcagaaaaagatgcagaagataagttttccaatatttctgacatggactataaaaaagtggacagttattttgtaagctattcttcggatggacacaaagcagatgaaattgtagtgattgccgtgaaagataaggcagatgtggatgaggcaaaagaaagcctgacaaagcatcagcaggatcggtataatttgctgcagtcctatgaaccgaagcaggtcagccggattcaggatgggttggtttttacgaaagggcagtatgcagtccttattatcacaagccataatgatgatgtgcggaaagcgtttgaagataccataaaaagtaagtagtataaataggatcgtgtttgagtaaaatatagaaataaaaatgcaacattcttttatagaatgttgcatttttatttacacataatatatcggacgattgttatgttacttaacccctaaattcaaaaaaataaaaatattacttaaacctttgtgggcatggaatataatgccttttcgtattcctccaaagaatatttttttaaaatctgttctttggtcagaccaagatcaagcatattttgaatcgcttcgagtctctcttcacgtttaccttcgagtttaccttttgcttctccctgttccagcaattcctcagatcgtaatttcaaaatcttaccacccataatctcacccaatcctttcctgatagtgttgtcctccggaataatataattcgcaatctctttaattaagacaatcatattcatataaagatgtgatttgctttctttttccgatgccttttccaagcagtggttaattttccggaaatcatccagcagatgctgcagtttcttcgaatctgttccattgtgttttaaaaaatgctcataccgcaagatatggtacggaagtaaaattagcagtcgtttttcgaaaatctgatccacagtatattttttcgcctgcaaaacaggaacgcggtaatgtacttcctgaccgtccgcaaacttcacaatcgctccgtgatattctggaagcgatcggtgattgcgtatatagagtacgcatgactgcggaaattcaatctcccagatatcgttttcttcaagagaagcatgttcaattgcaatcgaaatatcatactcaaacatccggatgaccatcgtctcatcttttgttgactggcactctagatgatacatgcggttgtcgatccgaataattgagtccgtgattatcgttccatacttttcgtaatgttcgtttcgcagctgttcaaagtgttccgcttcgctgtaagaagtgtggaaaacttcattgatcagtggaatcaaaagttgcggcattttttgcgcgatggttcgaaatacatcgtcaaaaatcgtgctgtgtcctgtagtgttttttgcgttggcatccggcaacgaagttgccacaatgtcagtgttccccatgtagtatcctacctttcttttagtatatatcataaacatctgtttttacaatatggaaaatataagaaacagttgttatgaccggttttatgaagttgtgattccaatagtgatttacgagcgaaatactctccatgattgctttgcactacttttccggcagtgcctgtctggcatcagatttggaattatatgtgtttattggaaatagaataacgtatttacaaatagaagtcaaatgtttttattatgaagagaacgctttgtattgtggtgcagcaacaaagcattcccatatttttataaattgatgttcagataaacaagatctttttcatcctgttcaattccgagataccgtttagtgatgtggaaagaagagtgattaaagacattcattaagagagccggctggactccttcctgccatgcataatagccaaaggttttccggagagaatgacagctgatcgcctcttcactggttgtatgtgaggcatcttctttaataatgcggtaagcctgtgaacggctgagcggtttataagggtttgtccgtttggagaaaacatattcttccggatcaggattcttttccataaaatatagatacagggcatttttcgcgttctggtttatcgcaatataatttctttttcctgttttatgttcccatatcaaaaggtgatcccgaaaacagttctttttaaaatcatagacacttctccagcgaagatttaatagatcgctgattctcagtgcagtgtttaatcccaatacaactaaagtataatttcgcagatgcggttttacctgcttgtagtatgaactgaaatcttgcagttcctgtcggttacggatcggttgtgttgttcccataaaaattactcctttcaagccaaaaataaagtgcttttgtgacataaaatgcaacattctataaaacattgtcgcatttttgaaataaaaagaaaagaagcattttataaaaatgcagatgcgtaagaaaatgcgcaggacatacccgaggaaacagggtatggaatacatacatggaggtaacaaaatgctgaaactttcattgaaacaggggcaatatgtaaacattggtgataacatccgtgtggtctatgtaggtggttcaggaaatcacgcaaggctgctcattgatgccccacgggaactcaacattgccagaagtaccacggaagaaaatccggcacgaaagagagaaacctattatgcagagccgggcatttccagggaggcacagcaggagattaaacgaattctgtggaatgagcggatgaaggcagaggcaaagaaagatgcagagagtttgaaagataaatttaactcctgatcagttttaaattctggtaataggcggggcacacccgggacgcttcgcttattgcggtacatcgaacggtgtatggctaaatatacaaggttgcaaagcatcacagatgcttgtgacgcgttactgtgaagtgacgcaataagaacaccttaggaaaaggatttccggaggaaaagacataataccccgcatagcgggagttcaaggaggattcaattatgagtatggtagtacaacacaacatgcaggcagcaaacgcaaacagaatgcttggtatcacatccggagcacaggctaagtcaaccgagaagttatcttccggttacaaaatcaaccgtgcagcagatgatgcagcaggacttactatttccgagaagatgagaaagcagatccgtggactggataaggcttcttccaatgcacaggacggtgtatcttctgtacagaccgctgaaggtgctttaacagaagttcacagcatgttacagcgtatgaatgagcttgcagttcaggcagcaaacggtacaaactccaaggatacagaccgtaaggctattcaggatgagatcgaccagttaaatacagagatcgaccgtgttgctgagacaaccaaattcaatgagatttacctgttaaagggtgatgatggtgagaagacaattaatcttaaggctcatgatgctggattaaagggaactcttactgataatggcgatggaactgctacatttactatgaaaactttgaatgctggtgataccgtaagtatcggcggaaagaattataccattggcggagaagaagcagatgtaaagcagatgtttacagattcaaaaatcacaggaaaagcaggtgataaagtcactattaatggtaaagagtttacatattatgataaggcggcagatggacaaacagctctgaaaacagctggtttttatgcagagcagccatcggtagctgataaggatagtgcaactcctgcatacgcaagtacagatgctattgctgctcttaagagtgcaacaatttcagtgggaacaaagtccattacaacaattgatgatactaaggcagatggtattgatgataataatacttctgttatcacaaagcagaaagcatatgagcttgcaggaaaagagttactggctgcaaaccagatcggcgatactgtaggaaatgcagaggtaaagaatggtgataagagtgatttggcatacaatgctggtgacggaacattcaacatcaaagttggtcaggcaaaagttgccaatacattaagtttcagccttcatgtaggtgcagatgctgacatgactaacaagatcactgtcgacatcgacaccatgaattctgcaaaccttggaatcaagggcttaaacgtaactgacaagaacggtacagcagcaacctacgcaatcgatgctatttccgatgcaatctctaaggtttcttcccagagatccgcactcggtgctgtacagaacagattagagcacaccatcgacaacctggataacatttccgagaatacatcttctgctgagtctcgtatccgtgatacagatatggcaaaagagatggtaaactacagcaagaacaacattcttgcacaggctggacagtctatgcttgcacaggctaatcagtctaaccagggtgtactttctctgttacagtaatttcataatgaaccattgactaatagggaactctttttgggttccctattcttttaaggaaaaaagggagtatgaagggtgatggttataaatcaaaagttttttggtgcagatagtattttttctattattactacggtagtaatggtgtttgttagcatatttaccgcaggaagtgcaatttgtattgcctggacgcaaagaaaaaatggaaaaagaaatcatttaaataatttatctgtagaatttgttacggattttatccaacctttggaagagtatgaggtatctataaaaaataaatttgaagtattacatgatctggacacggataaagaaagagtaaaagttatgataggtgcattaggaaatatcaatgttcatacggagtttctctatttggaacagcataaaggagatattgaaaatgcattgaagaaaaaagaaaatgataaaaatgttggagaggaattctcaaatatttatgagtttgtaaaagctgcaagaaagtttaaatcggatattaataatatgcaaaaagaaatgagtcattttcttgaaggtgacgagacaccaaaaggacataaatttgatgaggatgatataaaaaatactggtggtacattgattggtaatatgttgaaaataacaaaaaaattaccccgggagttaaaaattaatgaagtacttaatgagatgaaaaataatagaggaatgtaatacatatgagaggaaaaactaaggaaagccattatcttattacaaaattatttgcaacggattacttttatttttattgtaagccattgcttttttttacatattttttcccatatcaaatttcaaagaatggacaattttctacttatgaagagtttgaatatgaaaagaaaatgaatgatattcgggaagaaaaatttggaaagtacggaaactatgcatcacaggggtttggaaatatagctttttataaaccatgtgttacatttcaatatttttataataaattgtgtttgtatcaaaaagaaaaaaataaatttttttgtattcgggaagatggaattcaggatatagaagataatattatgaaggaagatttgaaatatattcttaaagataaaaaacttttgctgaaaaagaacatgtttattccgaatggagttaaagaaatattattgttgcaattagaaaaatatgagaataaatatgtattgtcagaattattgtattatattgtatcggaaaatcatatgcttccagatattgatgcagaacgattaaagcagcatcagaaacaattttcagataaaaaagatgaatttaggcttaatatttgcatgaatttacgggaaaagatggatgaagacagaaaaaatcttgtggaaaaactggtacatgcgaaggcaattcaaatggtttgcataaatggaaacagtttattgaaaaaaaacgaacaaaatataacactattggaggagattattgaacaaaagaaaaagaataacgaaaagaatttaaatttagaaattattattgaaaaaccagagagcaaagcagaattggatgcatgtaaatttaaggaaaattttgagcatagatatatagtaaaaaaacagttgattcagcgtacaattacgtttcttgagcaaatatcaaagaaagttgcaaaaagacatatacatgtaaaaatgacagaagttgtattaccatatgcaattatgattgtaaaatttgaagaaaaagaaatggactatatgaaaattgacttatattctccttatataatagaaaaaaaagaaagaccaagtttttatatatttcgcaatatgcaagagaatttgtatcagcatttgttgttgactccctaaattagcataatactgatctgcttgcctgtctctggaatgatctgtatactgtcattagtttacagaaagaaaaaggtccccgagcaccctccgtgacaagtcgtgtgctctgagaccatggttaaaaaccatgattattatatcagactacacactggtcctcaaggaggattttggtgtttttgttgagagcagtgagaactcccatatttgtcccgtatgtcagggaacgctccactacagagattccagaccacgtatccgcaaaaaggaaggcggcactaaggagcagctgatgattcgcaggttccgctgtcagaactgccatgcttatcacaatgaacttcctgactgccttgttccctataaacactatgaggcagaggtgatcgccggtgtcctggacgaagtaattcttccagatgacctggattctgaggattatccatctttcagtaccatgctccgctggcttcaatggttccgtgaaaacctgcagcgtatggaaggatacctgcggacagccggatatcagatactgaatctgggagaggacttcctgttttcctctgactcgctgctcgacaagatcagaaacagatatcagaactggctggaacagcttctccggctgatctataacagcggcggatttctggtgccggtccgctggtagacctgtgcacctgctttggttcgtctgtcatgctggccgatagtatagtggccttagaaggaggtagctataccatgagtacagatgacacatttataaaacagcagtggcaggatcaggaagcccttcaccgtttccagctgatctcaccacttctccagaccggtctggatgatgccagacgccagcagctgcgcagaacgatcgctgatgagaacaacatttctgtccgcacgctctaccggtatgaaaaagcctttgcagaaaaacagttcgcaggtctcagaccggctgaccgtgaaaagcatcgttcccagagtcttccggaaaactttgagtttctcctggaacaggctgtccagctccgcagggaagttccggaacggtcagttgcccagatcatttacattctggaagcagaaggtcttgtggctcccggcattctgaagcgctcaacccttgaacgccacatataccgggctggatacggtcggaaccagatgcagatgtataaagaggccaggaacagttcgtccagacgtttctgcaagcctcaccgtatgatgctggtccagggtgatatcaagtatggaccgaaacttcccattgggaaaaatggtgcaaaggtacagacctatctgtcctccgccattgatgaccattccagatatctgctgtcctcacgattttacgataatcaggaagaatccatcattgaggataccttccatcaggccatctccagatatggagtctttgatgcctgctactttgacaacggaagccagtacattgcaaagcaaatccggttctcacttgcaagacttgggatccgtgtcatgcatgcaaaaccacgttccgggaaaagcaagggcaagattgaaaagttccatcaggtggtggatgactttatccgtgaatcgaagcttaaaaatatcaggacactggaagaactgaaccgtctctgggctgtctatctggaggaatactatcataagcagaagcatgccggtatcgcagaatactacgaaagccttggagccgctgttccggaagaagggatctccccacttcaggagtggaaccgggacagccgtccgctgacctttctggatgcagcggtggtatcggaagcttttctccatcatgagcagaggaaagtcgaccggggagcctgcatcagcttccgtggaaaacggtatgaaacgaaaccttccctgataggacacacggtagagatctcttatgatccggcagccccggagcagatcactgtctcctatcagggaatggaactttttaccgcaatgccggttgtgatcggtccgtattgtgataagagtccggctcttcctgcttccatgcaggaacagacccctacgacttcccgctttctggatgcactggaaaaacgtcatgaacagaaccggcggcagatggcggatgccatttcctttgccgcgtaccggaaggaggcggatgactgatgtatgaagcattctttggcatggagcacacgccatttgtccgtgatgtcccaccggaaaagctgtatgaatccaatgcattccgtgagaccctcggacggctgtcctatgtggcagaccgtcagatgtttgccgttgtaactgcggaccccggatgcgggaaatcaaccctgatccgccgtttttactcggaacttcccaaagaggattacattgtcctgtatctgtctgactcaaagctgacaccacggtggttttataaagggctgctggaccagctgggactggaatcccggttttaccgtggtgattccaaacgccagctgcaacaggagatcgagatcatccggggagtgcagcacaaaaaggtcgtctgcatccttgatgaagctcatctgcttgaaaaggaaacactggaagaattccgttttctgctcaactacagatttgattccatgagtcctatggctgttgtactggtcggtcagaccgaactgtgggaaaacaagctgaaactgcagcggtatgccgcagtccgccagcgcattgatatgtactgtaccctgccacacctggacagatctgagacagaacagtatatcgcaagccatatggattactccggatgtacccaggaggtctttacagccaaagcgctggatgagatccataaagcatcggccgggatcccacgtatggtcaaccggatctgtgaaaaagctcttatgtatgcatttcaaaaccagaagcgcctgatcgatgattatatgatcaagttcgtcatagagcatgaaatgcttggaaccataacaacgtaaagcttattgccgcctggattcaggcggcagccctgtggggctggctgatgacagaaaacaagtcaatctgatgacagttcatgtaagcaaatccgtgacagttcatgaggtcagtaacaagcatttccaaaatgttttttataatatatggaatgatgatgttaattctgtatttttaattggagaagaaaatgattagtgaaaaaaaatattatgactttttgtatgaaaattttttagtaaaaaataaggagcaatgggaaaaagctaatttatggtgtgagaatcatactttttgtaaaatggatgaagagacagaaaagcttcttgagttattgaacggaatagaaaaaaaatatgagtttaatttgcaaagaatgtgcagaaataattttgaacttttatcattgtatcaaatagagtttcttggccaaataaaaaagaggcaaagaagtatcggattgaaatttttgatagtttgttgtttagcggataaaatattggattctaagcgtttttgcacagaggagcagcaaaaaattataaatttgttaacaatggaaagaaggaggcaggaagcttctttttttgaattgggtgaattattagaggagattgatcattatatagaggaatatgaaaatacagaattaaaggaaaaaattttaaaattaatatcagatgcttttacatccgaacaatatatgtggagacatttgttactggaaaaggaagcttttaatcaaaaagtgatagggctattgacagataaatctgttaaatttgaaaaggctgttttactactttcgttaaaagaagaaatgtcgaaagcagcgattgaggcagcagatcttatcggaaaaattagctggcttacagatgatttgtgtgactttatatcagacattcgggaacaacgaaaaaattcactcttatattttgaaatgccggatgaagagatggatcttgaatatagagcggaaatggtattggaacatatgagtaatcatataagaagacttgaagattatttaaaaaaattagaaataatagcaccgggtgatttgtatttttatattataaatatggtaaaaaggtggtttgcggacattgaggattatgaaaaagagaataaatagatttttcgtaactattcagaattccttcgggttcaataaccacttgttgtgcaaaacagagaattgaaaaaatttttctactccggtttgctgttactttgtgaataaaaatgctgtttttttatttggatggctgtcttgtggataaagcactatcatccgtatttcattcgcttcattttcgtcttttgagacgattttgaatatatttattagcaatttgcaccttcaaatttaatacttatccactgtcatttcgctgagtagattttgtgacagattcgcatttttacagcgtttctgatacaataaaaacataaaattcctcggaaagaaggtggtctgaatgccagttaacatcacagaagaattcgttcgtcagcttatggcgcaggttgatttcctgacgaagaagaacagaacattaacagctactttccgaagcgaagaaggcgcacaggaatatcttactatcatgagttacatcggatcagcacgcaagcatggaatcaatgctttcactgctatccgcgaagcactgaacggaaacccagatatcattttcaactaacggggttctgaatagatacgatttttcaagtaaaattcatgagcaaacagattttttactggtaggaagatagggaggattattatatgatttatttgtaaatatctgaagcaaaggaggaaagtgctatgcaggaaaaaaagatttattcagaaaagttgggaaaagatatatcaatttcacagtgtgtaaatgaaaatgagagtcgtattatcatggaagatgtggactgttccatggtagggtggacacataatggttggaacaatgataatggtggggcaagtagttggtaaaaatatgagtcgacggtcagaaataaatttctgaccgttatggctttatggaggaaagatgaaaaacggtgtatatgttgcaatttgttatatatgcaatgaaaaatgtagtttttgtccttgtacaaaaagggaaaaattagaacagaaaattgtaaatgtcaattctctgttttttttatttaaacaattacaggaacaacattgtatgcagataacaatttcaggtggggaaccaacacttcatccaaattttattgaaattatatcttttgcacaaaaatgcggaatgtatgttacggttttaagtaatggagaaaattttgcaaataatgcttttgtaaatgaaataaaaaaatgtatagatataacaaaattacgtataattacaactttacatagttcgattccagagaaacatgaattggtaaataaaagcaaaggaagttttcataaaagtgttgctggtctgaaaaatatgtatgaactgggggcaaagattgaaattaagcattgtattacaaaagaaaatataagacaactggaacaattttatttgtattgtgacaatgaatttcctgaaaatgtaaatatacaattttgtggaattgattatgttggtatagagaaaaaacaattggaaaaagcttttttatcatccgaagatataaaagaacaattggaaaatacatttgatctatatttaaataaaaggaaacatggaagtaaaaggcatctgtatgcaattaatattcctttgtgtgcctgtgatgtgtattattggaaattaatgtctttaaaaaaagatatagtgtatgagggatatgcagatccatatagtaataacctgatggaggcagaaagaaatgttgctgtcagtgaaaaatattgtcgggaatgcaaagcatatgaaatctgtaatggaacctacaagacagcatttgattattttggagaacggcttgtgaagccatatttataagatgaaaaaaacacaaattttatggaatgaaagtaaaaaaaatatgttgagtatatctccttacgcgaatatatttgttgatcgtcaaggaagaattttttgttatcgtgagactttggaaaaaaatattatgatatcaggtatggattataagtgtgcaaatgaactggtagaatatttatcagttccaatcacagaagatgaattgagaataaaaataataaaattactgggtaaggatgcagatgaaatacttgaattaatgatatcacaggagttaattgaaaaatgcggatagagtatatacaatcatttcaaatagataaaaatgttacatttacaggagctatggttgccattgaaggtacgaaagcatttatgattcaaaagtgtggatatattcttttaacagatatcactgtcataaatgttttacaatgtaaaactgttccggaatatttatacagaatattaaaaagtcgaaaatttcttataagttcaaatattaaagaaagtaaagaaaaagagatagaagttcgaccagagttttttatgattgatatgacaaataaatgtaatttaagatgtaattattgcttgagaaatttggaacaagaagaaaattgtatttcaacagaaaaattacgggatattggaaaatttattacaacgtattgtgacgaatataaaattgcaaatatcagcgtacaggcatggggaggagaacctttgttagaaaagaataaaataattgcactaacaaagtttataactccccaaaaaaccaaagtacattattcaattgaaacaaatgcaacattattaactaatgatgttatagaggaactttataaaaatcatataggtattggaattagtattgatggggatagaaaatgtcatgatttacagagaacatttgtctcaggtaaaggcagctatgatactgtaaaaaaaaatcttttgcaagcacaaaggtactataaaaataaaataggtacaattactactataacaaaacaaactgctgtacatatcgaaaaaataattgaacatttggttttggacttacacataagtaatataaaattaaattttgtgcatgcaagtacatacacacatggacaaaatcaatgtttgaatacgcaggaaattgcggatacagaacttcgtattttatataaaattattgaattgcaggagcgtggttatgatgtaatggaacacaatatatttattaagttgaaaaacctgttgtttcgcgaatatgcggatatatgtctttcttgtggttgttgtggtggggaaaaaatgattgtatttgatatggatggaaatatttatccatgtgaattaacggatgatgcaagttttgtgattggaagcatatataagaaagagtcattaatagaacaaattaaaatgacaattgataaagataaggctttttttaagatgaaaaaagcagtcgagtgtgaaaagtgttactggaaatttttttgcagaggtggatgtacagttcgggcattgagtgaaaaaagacaaatggaagttatagatattgatcatattgaatgtgctattaatcaggtgttatatccagcacttatggaattagttttaagaaaaccacatattgttaatcaaatgctgggagaggatttgttagtagatgaataagaataaggacattttgctggatattttagaaaagaactgggaaccagaacagatatataatatgtttcccaacccttctccttggaaaaatgaaatagagcaggaaaaaacaggatactgttggcttattactgaattacatgcattaatgtattttatgagtaaaaagtatgggacgaaagatatatatttttcattaacagatttgatagtttttgataaagtggaaaaagcaaattgtttttttgaaaaagtatataagacaagaagattgcctacaacaaatgaggaagtaacatatattttgacaaatgctatgtccgatagaggacattgggaaatgtccgtaaacttaataaaaaaatatggacttgttccgatagaaaaaaaagagtgtgaaaaaaataatttgcgtacaggtgaaattaatgctgttttagccttcttaatgagatattatgcttccattattcgagatagggaaaaggtaaaaaaaataaatgattttttacaaataaaagaaattgcaatgaaaaaaataaaagagattctttatacatatattaaaaaaccaaaggaaaaaattcaaattccggattatataaaaaagaaagaaaaaagttggatatcgccgaaagaattttatgatcgatatgtttgttttccatttgatgattatgcatgtttttttgtgggagcaaatgaacaagatagcgttattaaagtttctttgaaatcgttgggaaatatatacgaaaatggttcattaactttttggaaaatatcctccgatgtaatgtataatggaatatataaacagctacaacaaggagatacttgttggataggattggatggaggtaaatttttatttagagatagtggaatttatgatgatagtgtttttaatataaaagaaatattaggatatgatgtacaattgaattctgaaatgatttccttgtatagaatggcgaaaacgacacattctatgttactattcgatatggcttctggagaatgtggaaaatggtggagagcacaaaataatattgaaaattatgaaacacataatgaaaattttttcatatccgatagttggttgaaaaaatatgtatttatagctgttttaaataaaaaaaatattaatatggatgtatttaaacatgtgtttttagagccatggaaaattttataacatgtaaatatatttcattggttatgttatttgaaaaggtaaaaaatgtcagttgaggtggaaatgtttaccttgattattttccataagattaaagaaaatatcagatctgataacaaagaatggattcaggcacatacaaagctgataagactttgtatgcgcctgtttttgattctgcccgttggtaaaaaaaagcaattcaatttggcaaataatctccaaactgagtagttttatcttcatcagtttggagatttaaataacattaggatcgttctatactttttcaggcatagaatttaatgcttcctcatattcctcaggagaatattttcttaaaatctgttctctggttaaaccaagatcaatcatattttgaattgcatcaattttggcttcatgtagtccggtaagcctgcctctggcttcccctcgagcttcccctctggcttcccctcgagcttctccaagctccaacaactcttcagagcgtaatttcaaaatcttaccacccataatctcacccaatcctttcctgatctcattaccctccggaataatataatccgcaatcttctcaatcagaacaatcatatccatataaagatgtgacttttgttccttctcagatgtttgctcaagtctccggttgatctcccggaaatcgtcgagcagatgctgcactttctttaaatccgttccgttatgcttcaaaaaatgctcataccgtaagatatgatatggaagtaaaatcagcagccgtttttcaaaaatccgatcgaccgtgtatttctttgcctgtatgatcggaacgcggtaacgaattttctgaccgtccgtaaactttacaatcgcttcgtgaaaatccggaagtgaacggtgattgcggatgtaaagtacgcacgactgcggaaattcaatttcccagatcgcatgcttcgcaaaagaagcatgctcaagcgcaatcgaaatgtcgtactcaaacatccggatgaccatcgtttcatctttggaggactggcactccagatgataaatgtggctgccgatccggataatggagtccgtgaccacggttccgaatttttcataatgttcattccgcagctgttcaaagggttcctccttactgtaggaagtgtggaaaacttcattgatcagcggaataagaagctgtggcatcttttgtgcaattgtccggaacacatcatcaaaaatagtgctgtgttctgtcgtgttttctgtgttggcatctggtaacgtgtttaccgaaatgtcagtgttccccatgtaatgtcctgcctttcctttagtatatatcataagcatctgtttttacaatatggaaagtgtaagaaacagaagcagttatgatcaaacgtatgaaattgtaattataatggtaatttgaacgaatgttctttcatgaatgctatgagatataattaaaatacatctcatagcatagaaataagaaaaatacagttatagacggattatgtcatgcttttaccgacatagaatttatcgcctcttcatattcctctggagaatattttcttaaaatctgttctctggttaaaccaagatcaatcatattttgaattgcatcaattttggcttcatgtagtccggtaagcctgcctctggcttcccctcgagcttcccctcgagcttctccaagctccaacaactcttcagagcgtaatttcaaaatcttaccacccataatctcacccaatcctttcctgatctcattatcctctggaataatataatccgcaatctcctcgattaaaacaatcatatccatataaagatgtgacttttgttccttctcagatgtttcctctaactttcggttgatcttccggaaatcgtcgagcagatgctgcacattcttcgaatccgttccgttgtgcttcaaaaaatgctcatatcgtaagatatgatatggaagcagaatcagcagccgtttttcaaaaatccgatcgaccgtgtatttctttgcctgtatgatcggaacgcggtaacgaattttctgaccgtccgcaaacttcacaatcgcttcgtgaaaatccggaagtgaacggtgattgcggatataaagtacacatgactgcggaaattcaatttcccagatatcatttgattcaaaagaagcgtgctcaatagcaattgaaatatcatattcaaacatgcgtatgaccatcgttttgtcttttgaggactggcactccagatgataaatatggctgccgatccggataatggagtccgtgaccacggttccgaatttttcatagtgttcattccgcagctgttcaaagggttcctcctcactgtaggaagtgtggaaaacttcattgatcagcggaatcagaagctgtggcattttctgtgcaattgtccggaatacatcatcaaaaatagtgctgtgttctgtagtgtttttctcgttggcatctgacagcggagctgccacaatgtcagtgttccccatgtagtatcctgcctttcctttagtatatatcaaaacaacatagttttacaaccgaaaaaaacgggaaaaccgagtcgtttttgatcctgtatttaattaaaattccagtggataaacgagcgaatgactcatcagatttggaattatatgtgttaaagacagaatatcttatttgcatgcagaaatcaactgtaaatatcaaaaagttgagaatctgtaccagcggtgttactgttcgcagggtaacctgtgaacagtaatccagtggtcaataatccgctggcagggtgacaaaaaaaagaggccacaaccatgacaggatatgacctctctttaaaaattgtttcctgaatgttagatcttcattgtaagctgaatccgttgctttttcacatccacactcagaactttcacttccacgatatccccgacgctgacgacttccagcggatgcttgataaagcggtcacacatctgcgagatatgtaccagaccatcctgatggactccgatatccacaaaggcaccgaaatcaatgacatttcgcacggttcccttcaataccatgcccggagtcagatctttgatctcgagcacgtcactgcgcaggattggttttggcatatcctcacgcggatcacgggcaggcgtttccagttcctttacgatatcccggagagtcagttcaccgatttccagatcctgtgcaagctttttgtaatcccggacttttttcgagatcccggcaacattgcgatctgtcacatccgaaagcgtatagccgagtgtttccagcagctgtttcgtggctgcgtaggattccgggtgtacaccggtggcatccagagggttttttccgtcactgatgcgcatgaagccggcacactgttcataggcttttggtccaagcttggctactttcagaagctgggaacgggaggcaaattttccgttttcttcgcggtagactacaatatttttggcaatggctttgctcacaccggagacatattccagcagggaggcagaagcggtgtttaagtccacaccgacacggtttacgcagtcttccacgacatgatccagcgcttcggtcagtttcttctggttcatgtcatgctggtactgtccgacaccaatggatttcgggtcgatttttaccagttctgcgagtgggtcctgcaggcggcgcgccatggatgcggcacttcgctgtccgacatcaaactgcgggaattcttcggttgccagcttgctggcagagtatacggaagcaccggcttcgtttacgatgatgtattgtaccggttccggaatctctttgagaagctgtacaatgatctgctcggattcgcgggaagcagtaccgtttcccagagagattaatgtaatatggtatttggaaatcagttttttcagtaccgctttggcttcgtccacgcggttttgcggggcagtcggatagattacggtagtatcaagtacttttccggtcggatccaccacagcgagtttgcatccggtacggaatgccgggtcccagccgagcacaacctgaccggcaatcggaggctgcatcaggagctgctctaagtttttgccgaatacacggatggcaccgtcttcggctttttcaaacagatcgtttcggatttcgcgctcaatggcaggtgcaatcagccggttgtaagcatcctctgtaacttcatgcagtacagctgctgtgggagcagaaggtgcggtgatgagtttacggtcgagataggaaagaatccggtccacgggtgcatcaatttttactgtgaggaatttctctttttctccacggctgatggcaagaatccggtgtccggcaagctttgaaagactttcgctgaattcataatacatctcatagacggattcggcttcgggatcttttgcagcggataaaagctgtccgtgcttcatagtcagttcccggatatgggtacggaaatcggcattgtcggagaccgactctgcaaggatatcttttgcaccgtttaaggcatcttctgcggtggaaacttctttttccgggtttatatagttttcggcttcctccagaggagaaactgtcattttctgaagaaggatcaggttggcgagtggttctaagcctttttcttttgcaatggttgcacgggtacggcgcttcggacggtacgggcggtacagatcatccactgcaacctgtgtttcggccgcgagaatctgtgcacgcagttcctccgtcagttttccctgttcttcaatggaggccagtacggtctgttttttgtcctccagatttcgcagatacaccagacggtcatagagatttcgtaaaatttcatcactcaatgctccggtagcttctttccggtaccgggcaataaaaggaatggtgcatccttcgtcgatcagttttacggcagcggaggcctgttcttttcgaatgccgagttcttccgcaatttttgtattaatatccataaattttccccttaatagtcctttcctgtcaaataatactttccctattatatatgaaatgttacaataaaagcaatcctaaaaagaaaggaaaacgtattatggatatgtatggatcatcttatcaaccaaatccgaatcagccgtatcgcagccggagatctgcacgcatggaggcagcttccctgatacttggatcaattgcattactaagctgcacctgtctgtatcttgctgtgccgtgtggggctctggcggttatttttgcaacactttcccgcggaggcatgatgtcttatacttcgaaagcacagatcggaatgattctggggattatggcattggttgcggctatcggactgtacgcatcggttctggggtatgccatccatcagtatggaagtatcgatggatttttaaaggcctattctgatatgcagggcgtggattataatgaactgatggagcagttcatggcaaaataaaaagattgttgcatctgcatagccatgctataatgagaaaagcaatcagttacagaaacggagtataaacaaatgaacctaccttgcaaagaattaaaacgaatcgcaagagacaatttaaatggaaattataaaataccaatgggagcttttcttgccgccacactgattcctttggcggtagaactcccattttccatgttgcagaaagatgcacagccgcttccggtgacgatcatgttttatgtggcggaatttctgatcacacttttaagcatggtattgtctgtcggaatccttcagcttcatctgtcacttgcacggaaaaaagaaatgacacttggcatggtattttacgggtttaaaaatcacccggaccgttatatcattgcaggactgcttttgattattgcaacgctgatcagctgtattcctgtgatcacaggtgctgtgttattttttgtcctggacaagtcgcctgcggcgattgcagtactggtgatacttggtattgtgagcacgattctggcagttttcgtgcagatgtggtatgcactggcattgtatctgcttttggatcatccgcagatgaaggcacgcgaatcattaaagatcagccgtcagatcatgaagggaaataaaggaagattattttatatttatctgagctttatcggattgcagatactgtgtctgctgtctttaggcatcgggtcactctgggtatatccataccagtcacagacactggttattttttatctggatgtggtcggggagatcccatcaaacataagctaatgctccggctgattgccggatattagaatatactattattaggaggagtttttcataatgaaccaacaaaaagacattataagagatgccagggttttgggcacgccgaaaatgctgctgcttggtctgcagcatatgttcgctatgttcggagcgacaattcttgtaccgattctggtaaacagctattttcagagtacctcacaggtattgtccgtacaggtgacattgttctgtgcaggattcggtaccttgtttttccatctgtgtaccaaatttaaggttcctgcttttctgggatcttcatttgcttttctgggaggcttttccagcgttgcggcactggataccgggatatttgccaatatggcagataaagaaaaactgcagtatgcgtgtggcggaattgtcgtggcaggattgttgtatctgatccttgcactgatcatccggtgcgttggcgtaaaacgtgtgatgcgtttccttccaccggtggtaaccggcccgatcattatctgtatcggactgagccttgcaccgtctgcggtcagcaatgcatccacaaactggctcattgcaattgtggcactggcggtcatcattattttcaatatctggggaaaaggaatgttcaagattattccgattcttctcggtgtagtgatttcgtatgtgtttgcactggttctgcagggacttggttttacgaatccggacggatctgttattttaaatttttccggcgtttcctcggcggctgttgtcggacttccaccgtttatcctgccgaaatttaatcttacagcgattcttatcatggcaccgatcgccattgcgaccatgatggagcatatcggagatatttccgcgatttctgcaacggtaggacagaactttattgaggacccgggattgcatcgtaccctgatcggtgatggaattgcaacttccatttctgcaatgatcggaggacccgcaaatacaacctatggagagaacacaggcgttctggagttgtcccgtgtacatgatccgaaggttgtccgtcttgcggcatgttatgcgatcgttttaagttttatcccgaaagtagcagagattattgcttcgatgccggcatccattattggcggtgtcagctttattctttacggtatgatttctgctatcggtgtaagaaatgtggttgaaaaccatgtggatttcaccaagtccagaaacctcattattgcaggtgtgatcttagtttccggtctcggattctcagatggactgacctttacgatcggaagcacttccattaccctgacatcccttgccatcgcagcgattgccggaatcgtgctcaatgcgattctgccgggaaatgattatgcatttggaaaagacccggaaggagatgcatctcgcggtgtggatctgcgtccgcatgagctggagcaggaactgaaaaatcagaaatagaatgtttatccaagaagtgcaatgccaaagacggcgagaaacagatttttgaccagccagttgagcagtacaatggcaagcgcgatccacagataaatatcacgataatgcatcccgatggcaagacgcccgcgggatgctttttctatggtctgggacagcataaaccagccgaaaaagacagcggtatacacaacaatcggatggtaaaagaaagagcgcacaatatgtccgtgcagcagggcatgaattgcgcgtgtgccgccgcatccgggacagtagtacccggtcagattgtgcaggacacagccatccggagggaatatccacaggaaataaccgtttttccatgcaagtccgagcacgagtgcgagaataagacatacccagccaatgatataaaaagaaaaatctaaagttttgtccgtgcgtaatatatttgaaatcttcatggaaattatgttagcaaatggatgggaaaaagtccagatggtgttgacattttcggacaatgtgaatataataacgatgaaaaataaagaaggaattcttcggggcagggtgctgaaagaaagtgctggaatgctgtattttaggggattctttgaagaaataaaattgtttggtgacaatttggtgacattttgaagaaaaaataaagatttttatcataagagagctgttaggactgccgtatccggttgggtacggcggtctttttttaatattaaagagcttggagcagtaaaagctgaaaagaatgaaattattgtatgtagatatggaacttcatggtataataatatagaatataccattatctatcaatatttaaggaaggagatggataccagtatgactatagagagaaaggtaagcagtattgaatccagtttcagaatggaaaacatgaagtttgatgcagagtgccgtacaagagtaaggaatgtcttgactaaaaagatatcggctgcagatgcggttgctgaacttaacaagaaatacaaagtatcctccaactaaacgtgaaagatcaagaatatgattatttttatgatgacgagcaggatgctgtttattgttatcccggaaccaatatcctaaaaaataagcttaatattagagatattgaggttttacatgaggcagagagagattattcatccgttcgtcaggctgaattgacgaacaggggggtaacaggagatttctcttttaaacatctttgttcgatacacaaacatttatttcaagatatctacacttgggccggaaagacgagaacggttgacatttctaaaggaactattttttgtttagtgcagtttatagaagaacaatttgatgatttgtatagaaaacttaagaaggaaaattttttggcagatataacagataaaagagaaatgagtgttcggcttgctttttatttaggtgaactcaatatgatacatcctttcagagaggggaacggaagaactcaaaggatgtatattgagcagctatgccaaaataatggaagattcgaaattgatttcacggaagcaactaaagaagaaatgatattagcaagtgtacaatctgcaaatgtatcaaacgatttgctggaggcattgatttacaagtgcctcgttgggcatgtaaactagggtattcattcgaagtaaattacaattagtgaagattccggaagatcagattcgggaatataaagatcaggtttccgattgtgcatttgataattttatgaaatatggagttgatatttctccggtaataaagaatgaagcacacttcaatgaatggtcagacaattttctttactatagaaatgtgcgtgatgaaggggttgtaattaatgcaggataaagatagagacttatccggggatagacttttttaaaagcggagaggactgccataatatggcagtccgttttacatgctgtacttagagtgcagattgtgtttgaatatactgataaatagaaattttaggaatgcgccaggtagatttaccaattcgcattccttttattttgccttggtttaatagctcatagatacggttttttcctaccataagtatgtctgcggcatcttctacggttaataaggtcatagtatcttcaaatgaatttgcatagatttggtttgcttctgataagtttaacataatacgtcagtcctttcttagttattgatatttgtatgttaattgcataaaaagttatctcgtggagtaaaaacagaggtaattaattacaaagaaagacagaaggatttacgggttacatataatgtgtataatcatttggacgataaaagagtacgcatggagatgcaaagactggggatgatagatgcagagaagaaggttgatccggtgacttttggtgacaatttggtgacaaattagaaacaaaatatgccacctgatgtcaaaatacatcaagtggcattttataaaggaagattaaaaaaatgtcaaaaagcccgaaaatatcacaaaaaacagttgacaatcccaagcataatgcatacaatagtggcgtaaaaagaaataggaattcttcggggcagggtgctgcggatgacgcatattcccgaccgacggtatagtccgtgaactgctttttgcagccgaaccggtgagattccggtaccgacagtatagtctggatgagagaagaaaaagtgcaaattaatgtttgcattgttgactgtatgatagaaaaagaaccccgatagagaaatctatcggttttttatttcctgatcatatatgcaggcaacactcctctggaattccgttgattctgaaaggagagttattatgagtgaacagacaaagacagcagtaaagcagggaggcatgaatacaaaagtacgctatattacggttacagcgatgctttctgccgtagcgttcgtgcttatgtatctggagattgccattccgatcatgccatcatttatcaaatttgatttttcggatctgccggcactacttggaagctttgcgctcggaccagtgtgtggggtattgatctgtctgatcaagaacgttctccatctggcattttcaaacagtatgtttgttggagaactttccaattttattctcggagccgtatttgtggcaattgcaggtaatatctacaaacataaaaagaccaaaaagagtgcggtagtcagtggtctggttgcagcattggtcatgggaatagtcagtgtgttttccaattattttgtggtttacccggtatattacaaggctggtatggcagaggaagccatcctgcagatgtatcaggcaattgcaccatccatgaaaagtgtactgcagtgcctgatctgctttaatcttccatttacaattgtaaaaggactgattgcagttgtcatctgtatgctgatttacaaaccgttatctccagttttaaaaggacgtttaagtgaatactaaatggttttgggagctgtaaaaaaactcccctgacagaaaaatcgcccagaccgtgaggtctgagcgattttttggtataattaattatgctactaaataacaataccaatggtaattatactatgcgtcagctgaaattaccattagaaatcgaaaaattgatcgatatttccgatccggtatacactttttgtgaggttatggatcacattgacctatccagatattttttagagaaaggctataaaacaggtcgcccaagatgtgatgctcaaaaactccttaaagtaatactttttgcctttatggaaaatggcatctgctccttacgagaaatagaaaagctctgccgtaatgacattcgttacatgtatcttcttgatggcatgaaaacgccttcttttgctacatttggaaacttaatccgaaacgaactaaccgattctatcgagcagatatttgaagacattaattcatatatttttgccaaagatcacgtggatctgcagcatacatacattgacgggacaaaaattgaggcaaatgccaatcgatatacctgggtatggaaaaaatcgtgtgtgaaaaaccggcagaaagtctttgacaaaatttcactcttgattgatgctatgaatcgggaagtacttggatatctcggaataaaatttgaaaagcgtgaagcgtacgtggttgactatgtctctgaattacttacgatgtacaaagaaacaaccggactggatgaaacttctttcgtttccggacgtggtcatagaaaaagcattcgacaaaaacaatacgaagaattgcatgaatatctggaacgtttgaaatcctatgcatatcatatcgagacctgtggagaagaaagaaacagttattccaaaacagatcatgatgcaactttcatgcgtttaaagcgtgattacatgggaaacgatcagctacttccggcatacaacctacaggcagccatctgtgatgaatacatagctgtaatcgacgtaaaaccatatgcatccgatatggaatgctttgttcctttgatggaaaaattcaatcgcacatatggccactatccgaaatatccggttgctgatgccggatacggttcttacaataattatctttattgtgaagaacacggcatggaaaaatacatgaaatttaccatgtacaaaaaagaaacgacggacaaaaagtatcatgagaatccgtatcgtgctgtaaactttgcaaaagatgcagatggaaatctcttatgtccaaacggtcgaaaattcctcttcaagagaacacaacatgtgaaatataataaatatggaagaacggaagaattatacgaatgtgaatcttgtgaagggtgtcagcataaacaggaatgttgtccgagagcacacaaaaaccgaacgatccgaatgaatcaggaattaactgctatccatcaggaagtgctgcaaaatcttgaatccatacatggtgctctcttgagaatgaaccgaagtattcaatcggagggaacttttggtgtattaaagtgggataaagcgtataaaagattattgcgaagaggcgagaaaaatgtaattctcgagcttacactgatttcatgtggattcaatctttataaatatcacaacaaaaagcaacgacagacgaaagttgcataaaacttaagcaggcgtgattagccgagctttattaaatgcaccattttttatacccaaagatgcagacttgcttagaaatagaaaagttaatacaaagaaacgccaaaaccgacatttgccggaattggcgtttcttatattagggacttattttacagccccttttttttctcttttcttttgtttggaaaattgttataatatgatacaacgtaatggttttctgtgtgatacgcagaaagccttatcatttattttggataggagaagaaggcatgaaagcgtcatttgatgttacattatcacccaaagacctgtatcggtttaatatgtaccagacgtataccgggtttcagggatggagttccattgcacttggaattcttggatttgttatggctggaatcagttttcagaatggaaaaacatcttacaccctgctctatattgcagtaggatttttgtttcttctttatatcccggttgcactgtggtttcgggcaaaggagaccctgaagacaaacaaggtgcttgccggcacactgcattatgaaattacagagaaaaatattcatgtatcccagggaaaggaaactggggatatggagtggcaggcaatttataagattgtagcgaatgcaaagcagattttaatctacagcaatcggaaaagcgcatatattattcctatggagcagattggagatcagtatgcagcgttccggacacttgcagaacagaaactggaaaaatataaactcagaatgaaggcgtagaggcagtatgcaggataaaaaagttatggaatttgaaactttttccccggaggaaactttagagctcggaagaaaattcggaagagaggcacagcctggggaggtatatacacttgtcggggatctgggagtcggcaagacggtttttacacagggaatcgcacagggacttggaattgaagagccgatctgcagcccgacatttaccattgtccaggtatatgaagaggggcggatgccgttctatcattttgatgtctaccgtatcggggatatcgaagagatggatgagatcggatatgaggactatttttacggtgagggtctgacgatgattgaatgggccaatctgattgaagagatattgccggatcattaccgggagatcaccattgaaaaagacctggaaaaaggtttcgactacagaaaaataacaattttagacagatagaggacagaatatgaaaatactagcgttggacagttcaggactggtggcaggggttgcggtcacagaagacgacaatctgctgggggaatataccatcaattataaaaaaacacattcacagacacttcttccaatgttggatgaagtagcaaaaatgatagaacttgatctgaatacgattgatgtgattgcagtgtccgcaggacctggatcttttacgggactcaggatcggctctgcaacggccaagggactcgctcttgccctgaacaaacagattgtttccgtgccgacggtggatgccctggcatataatctgtggggatgtgaggatcaggtatgtccgcttatggatgcgcgccggcagcaggcatataccggactgtatactttttccgatgggcagatgcagacacttcttccgcagtgtgcggtaggaatcgatgaaattaccgcaaagatcaatgaaagtggaaagaaaaccgtatttttgggcgatggtgtgccggtttttgccgattacctgaaagaaaatttacaggtgccatacctgtttgcacctgcacattgcaataagcagcgtgcggcatgtgttgcggtactcggcggcattttataccgtcagggaaaggctgaggatgcagctgcacacaagccggattatctgcgcctgtcacaggcggaaagagaacgccaggaaaaggcaagggattttcgcatatgagaatacggcagatgaccgtggaagacattccggctgttgcgcaaattgaaaaagaatgtttttcccagccatggagtgaacagggattcctggatggaatgaaagatgctatatttttcgtggcggaagatcctcagatcgcaggttatattggcatgtaccggatgccgccggagggagagattaccaatgtggcagtgacacggaaaatgcgtaaaaaaggctgtggaagagagcttcttcttaggatgcagcaatgggccgaaaaacatggaattgaccggatcgtacttgaagtacgttccggaaatgagccggcgatacacttataccggacatgtggatttgaaaaaattggagtgcgaaaaaatttttatcagtttcccagagaggatgcagatattatggagtggaaacgattatgttagatgtatgtttgttaggaactgcaggaatgatgccgctgccgtaccggtggctgacatcacttatgctcagatataatgggagcagtttgctgatcgattgcggtgagggaacccagatcgcaatcaaagaggcgggacttagctttaaaccgatcgatattctctgcgtgacacattttcacgcggatcatatcagcggtcttccggggcttcttctgacgatgggaaatgcggagcggacagaaccgcttacgatcatcgggccaaaaggactcacacgtgtcgtgacggcactgcggacaattgcaccggaacttccgtttgagatcaattgtatagaactgacacagccggaagaatctttttctatccagggatatgacattcatgcgttccgtgtaaagcacaatgtcatttgttatggatattcggtggaaatccatcgtgcgggacgtttttcggtggagcgtgccagagaacagaatgttccgatgaaattatggagccgcctgcagaaaggggagaccatcgagcaggatggtgtgatctatgagccgcagatggtactcggaccggcaagaaaaggtctgaaagtgacgtattgtacagacagccgtccgctggataccattgtaaacgctgcaaaagaatcggatttatttatctgtgaaggcatgtatgcagaaaaagaaaagttaaataaggcaaaacagtacaaacatatgacgttttatgaggccgcagatatggcgaagcgtgcagaagttaaagaactgtggctgacccatttttctccgtctctggtaagggcggaggattatatgccacaggtgcgggatattttcgcaaatgcataccttggcaaagatggaaagagtgtggaattaacatttgaggaggaataggcgtatgaagaaagttgggattaccgttgtagcagcagtatgtgttgttttattgtgcgtgggattttatttcatgaaaaacagcgatggttcacaggcatcgaaagaaaatctgacggtggttcagagaatcaatgaaaaaaatctgacggatgattatccgaaaactccgcgcgcagtgattaaactgtataaccagatcattactagttattattccggaaattatacggatgatgagttcgacaagctgattgatcaggcgcgtatgctttttgatcaggatcttgccgataacaattccaaggatgattacaagaagtcggtggagacgagcattgcggattacaagaaccgttcctttaagatccgtcagaccaatgtatgtgacagcgatgatgtaaaatacctgacggatgatagcaacggggataaactggcatatgtcacagcttcttattttacggaagaaaataaaaagtttgataaaacctaccagatgtatgtgcttagaaaagacgataacggagactggaaaatccgtacattttataaaatcaaggggaattcgacagaggaagaataaaatgagtgacacagaacagactataaaaatacttgcgattgaaagctcttgtgatgaaaccgctgcggcagttgtggtgaatggccgggatatgcgttcgaatgtaatttcttcacagattgctctccatacattatatggaggggttgtaccggagatcgcatcgagaaagcatattgaaaagatcaatcaggtaatcgcacaggcactttcggatgcagatatgacattacaggatatggatgcgattggtgtgacttacgggccggggttggttggtgcactgctggttggcgtggcagaggctaaggcgatcagctatgctgcgaacattccgctggtaggggtacatcatatagaaggacatatcagcgcaaattatattgaaaatcctgatctgaaaccaccgtttttatgtcttgtggtctctggagggcatacgcaccttgtgaaagtgacggattacggaacgtatgaaatcctcggacggaccagggatgatgcggcaggagaagcatttgataaagtggcacgcgcaatcgggctgggatatccgggaggaccaaaaattgaaaaagtttcccatgaaggagatccgaaggcaatttcctttccgcgggcaaagattgcagatggggtatatgatttcagtttcagtggattaaagtctgcggtgctgaattatctgaacggatgcaggatgaaaaatcttccaattaatcaggcggatgttgcagcatcattccagcagtcggtgacggatgtgctggtggatcatgcgcggcatgcaatccgcgaatatcatatggacagttttgcaattgccggcggagttgcatccaacggagtaatccgtgcggctatggaacagatgtgccgtgaagaaggggtgaaattttatcatccttcgccgattctgtgcaccgataacgcagcgatgataggtgctgcagcatattatgactttattgcgggaaaacgtgcagggctggatctgaacgctgttccgaatctgaaattgggagaatgaccagatggaaaacaggaaacgctatacagcgatcgtacttgcggcaggcagtggaagaagaatgcaaagtgatacacccaaacagtttatggaactgtgtggacatccgctggtctattacagtctgtatgcatttgaaaagagtccggtagatgatattatactggtaacaggaaaagatgatgtttcctattgcagaaaagaaattgtagaggcttgtgatttcagaaaagtccgcgcggtgattccgggcggcaaagaacgttatctgtcagtatatgaaggattaaaagcagctgcgggcaccgactatgttctgatccatgatggggcacgtccgatgattgatgaaacggaaatccggttgtccatgcgtgccgtagaagaggagcatgcatgtgtgattggtgtaccggtaaaagatacgatcaaagtgggaaatgcaaaacattatgctgtggatacaccggacagaagctgtctgtgggcggtacagacaccacagagcttttcttatgaacttttaatggaagcatatggggaaatgtggcaggcagcagaatccggcgaaaggatcacggatgatgcaatgattgtggaacggtttaccggtcataaagtcaagcttgttcagggaaaatacgagaatatcaaggtcacaacaccggaagatttgttaattgcagaagtttttttaaaaaaagcaaaaaaaatgaaaaattgttattgacataaagagccggggatggtaatatatgtcttgcgctgattcagatgaacagcgaaaacagaatacggagaggtatcgaagtggtcataacgaggcggtcttgaaaaccgtttgtccgcaagggcacatgggttcgaatcccatcctctccgctaggcggttaagccgtttgaaaaagaattcgaaagaattctttttctgtgtcaatatcataacttctcgggagagaaaatgatttgagcagctatatggagaagtacccaagctggccgaagggacacccctggaaagggtgcaggtcgttaacagcggcgcgagggttcaaatccctccttctccgctttgaatcaaataaaaagattcaaaaagttgttgacaaaaagcgacagacatgataagatatcagagttgccgcgaaagaacgacaacaaagaaaaataaaaaagttgttgacaacgacttgaagatgtgataaaatatacaagctgttggaaataacaacaacgaacattgataactgaacagtgaaaaaccttgaaagattttgagaataattcaagaacgcttctataaagaagcaaccttaaaacagtaaatcaggacattgtttctgattaaaagccagatttaattctggcaggacaaaactttttaacatgagagtttgatcctggctcaggatgaacgctggcggcgtgcttaacacatgcaagtcgaacgaagcactctatttgattttcttcggaaatgaagattttgtgactgagtggcggacgggtgagtaacgcgtgggtaacctgcctcatacagggggataacagttggaaacgactgctaataccgcataagcgcacaggatcgcatgatccggtgtgaaaaactccggtggtatgggatggacccgcgtctgattagccagttggcagggtaacggcctaccaaagcgacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaagaatgacggtacctgactaagaagcaccggctaaatacgtgccagcagccgcggtaatacgtatggtgcaagcgttatccggatttactgggtgtaaagggagcgcaggcggtgcggcaagtctgatgtgaaagcccggggctcaaccccggtactgcattggaaactgtcgtactagagtgtcggaggggtaagtggaattcctagtgtagcggtgaaatgcgtagatattaggaggaacaccagtggcgaaggcggcttactggacgataactgacgctgaggctcgaaagcgtggggagcaaacaggattagataccctggtagtccacgccgtaaacgatgaatactaggtgtcggggagcattgctcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccgatgacagagtatgtaatgtactttctcttcggagcatcggtgacaggtggtgcatggttgtcgtcagctcgtgtcgtgagatgttgggttaagtcccgcaacgagcgcaacccctgttcttagtagccagcggttcggccgggcactctagggagactgccagggataacctggaggaaggcggggatgacgtcaaatcatcatgccccttatgacttgggctacacacgtgctacaatggcgtaaacaaagggaagcggagccgtgaggccgagcaaatctcaaaaataacgtctcagttcggactgtagtctgcaacccgactacacgaagctggaatcgctagtaatcgcagatcagaatgctgcggtgaatacgttcccgggtcttgtacacaccgcccgtcacaccatgggagttggaaatgcccgaagtcagtgacccaaccgcaaggagggagctgccgaaggcaggttcgataactggggtgaagtcgtaacaaggtagccgtatcggaaggtgcggctggatcacctcctttctaaggaaatcaagtagagatttttcactgttgagttatcaacggcgatgtttgcgaagcaaatattgtcaggataacaattaaataaaaccctttctagtgtcgatgcgcttaggggaaacacccgtccacatcccgaacacgatggttaagacttaagcggccgataatactatactggtaacggtatgggaaggtaggtggatgctagattgaaatgggggcgtagctcagttgggagagcacctgccttgcaagcagggggtcaagagttcgaatctctccgtctccattatcagcggatgaaaataatgtctgctgagaaatgtactttgaaaacttcatacagaatgataagatgattaaatatctatttgatcaagacatcgtaataaccgtaaagttctttaatgaataataagtaactgaccagaagttggttacgaaagttatcaacgctatgataacgaggattgaataatcaagcaaaaaagagcgcagggtggatgccttggcactaagagccgaagaaagacgtgataagctgcgaaaagctgcggggagatgcaaataatctttgatccgcagatgtctgaatggggaaacccggctggaaggactccagtcatccatacgccaatccataacgtatggaagggaacccggtgaactgaaacatctaagtagccggaggaagagaaagaaacatcgatttccagagtagcggcgagcgaaatggaaagaggccaaaccgttgtgcgtgcacagcggggttcggaccgcataattgattcagtgattctagcagaaaggttttgggaaagcctgccggagagggtgaaagccccgtaagcgaaaggaaaactgacaaggcggtatccagagtacatcgagacacgtgaaaccttgatggaacacgcggggaccaccccgtaagcctaaatactacttagtgaccgatagcgcatagtactgtgaaggaaaggtgaaaaggaccccgggaggggagtgaaagagaacctgaaaccctgtgtttacaatctgtggaagatctttatatgatcaaccgcgtactttttgtagaacggtccggcgagttacgcgtactggcaaggttaagtgcttaaggcacggagccgaagcgacagcgagtcttaactgggcgatgagtcagtacgagtagacccgaaaccgggtgatctatccatgtccaggatgaagatgccgtaaaaggcattggaggtccgaagccacatccgttgaaaagggtgggcatgaggtgtggataggggagaaattccaatcgaacccggagatagctggttctcctcgaaatagctttagggctagcctcgttttagtcttatggaggtagagcactgaatttccgcgggggcgtcaaagcttaccaaagaatatcaaactccgaatgccatgtagatgatgaacgggagtcagactgcacgagataagttgggcggtcaaaagggaaagagcccagaccaccggctaaggtcccaaagtgtgtgttaagtggaaaaggatgtgggaattcgaagacaactaggatgttggctcagaagcagccatacattcaaagagtgcgtaacagctcactagtcgagagtccctgcgccgaaaatgtccggggctgaaacacaacaccgaagccgtggactccgtaaggagtggtagaggagcattcttaaaaccgacgaagctgtaccggtaaggagcagtggagggataagaagagagaatgccggaatgagtagcgagaggaaggtgggaatccttccggccgaatatctaaggtttccagagtaaagctgatctgctctgggtaagtcggggcctaaggagaggtcgcaagacgtatccgatggacaacaggtttagattcctgtaccgcatataaacagaactgtggggacgcatgtggaaagcataagccgggaatggaaagaccggtacaagcggggtaggtgtgtgacaggcaaatccgtcacataagccgaagacgtgatgtggagcgaaattaagtagtgaagtatgtgagccatgtgccgagaaaagccgctattgttttatatgtgcccgtaccgtaaaccgacacaggtggatgaggagagaatcctaaggccgacggaagaagcattgttaaggaattcggcaaaatgaccccgtaacttcgggagaaggggtgcccactgaatggtgggccgcagagaataggctcaagcaactgtttagcaaaaacacaggtctatgcgaaaccgaaaggtgaagtatatgggctgacgcctgcccggtgctggaaggttaagaggagaggttagcgcaagcgaagctttgaatttaagccccagtaaacggcggccgtaactataacggtcctaaggtagcgaaattccttgtcgggtaagttccgacccgcacgaaaggcgtaatgatttgagcactgtctcgacaatgcatccggtgaaattgaagtaccagtgaagatgctggttacccgcgccaggacggaaagaccccatggagctttactccagtttgatactgggattcggtactgcacgtacaggataggtgggagactgagaactatggacgccagtctgtagggagtcgctgttgggataccacccctgtagtactgggtttctaaccatctgccgtgatccggcagtgggacaatgtcaggcggggagtttgactggggcggtcgcctccgaaagggtatcggaggcgctcaaaggttccctcagaatggtcggaaaccatttgaagagtgcaaaggcagaagggagcttgactgcgacaccgacgggtggagcaggtacgaaagtaggacttagtgatccggtggtataaagtgggattgccatcgctcaacggataaaagctaccctggggataacaggcttatcactcccaagagttcacatcgacggagtggtttggcacctcgatgtcggctcatcgcatcctggggctgtagcaggtcccaagggttgggctgttcgcccattaaagcggtacgcgagctgggttcagaacgtcgtgagacagttcggtccctatccggcgcgggcggaggatatttgagaggagctgtccttagtacgagaggaccgggatggacggaccactggtgtatctgttgtcgaccaacggcatggcagagtagccaagtctggaagggataaacgctgaaggcatctaagcgtgaagcccccctcaagatgagatatccctccttcgggagtaagaccccttgaagactacaaggtagatagggcagaggtggaagtgtggcaacacatggagctgactgttactaataggtcgagggcttgattaaaaaagctgttaaatctgtatgaagttttgaaagtatatactttcaattgataatcctcgatagctcaatggtagagcactcggctgttaaccgagttgttgtaggttcgagccctactcggggagttattttatgtaagatgttcttatgtaagagataaatatggctccatggtcaagcggttaagacatcgccctttcacggcggtaacacgggttcgattcccgttggagtcactgactgtaaagctgatactcagctgagcatcaaaagagcttattcgccgatgtggctcaattggcagagcagctgatttgtaatcagcaggttatcggttcgagtccgatcatcggctttttcttttttggaccattagctcagttggttagagcaaccggctcataaccggtcggtcctgggttcgagtccccgatggtccatttttttacttgaaatactcgataatatatgttataatgttcaacgatctggcctagtggctcagttggttagagcgccgccctgtcacggcggaggtcacgggttcgagtcccgtctgggtcgttttagtaattgttttacaattacggtatgggatcttagctcagctgggagagcatctgccttacaagcagagggtcacaggttcgagccctgtaggtcccattcatgccggcgtggcggaactggcagacgcgcaggacttaaaatcctgttgtggtgacacagtaccggttcgattccggtcgccggcattacactatgatttatagtgttaagtaaatatgtgtgcgtagctcagctggatagagcacttggctacggaccaaggtgtcgggggttcgaatcctctcgcgcacgtatgaaaaaaggagcaagacgtaagtcttactccttttttagtatgtgtgcctagcggcgcacgtttctaacgggttaaagtcccgaatccgcccggtagtgggaaggatatagccgaaagcaagggtgtccatcgtgagatggaatctgaaggaagctggatgtgaggaacatactaactcatgggcaaatctctggtctgacggacagaaatctcatataaggttatgcatgagggtaaggttgcatatcaaattgaagcccaatagctacacggaatcatgcatgataaatgagacagatggatggagaggaagaaacgtgtggtacctagggaggtctgtgcggtacgccttgaaagaggtaaccattgcataaagcaatgctgaacgcacagaagtcagcagaggtcatagtagccgagaggtgaaggaccgaatcagtaggagtcttgagtatgaccgagaaaggaggaatgaccgtctatggcagaaaacattgaaaacaatggctgttcgcaaagagataatgcagaacatgaagggtatgtgaaagcgtctaggtcattcaatcggatatggaaagaaagggacagtgcacagccgagacttttggaagcgatactgtataaagacaactttaacagagcgtataagagagttaaggcaaacaagggagcgccgggaattgatggcatgaccattgaggaggctcttccttatctaaaggaacatcaacaagagataaccgaccgcatttatcgtggaaagtatactccgtctccagtaagacgagttgagattcccaaaccagatggtggtgtgcgaaagcttggcataccaacagtggtagaccgtacactccaacaggcaataacccaacagttagtgccaatctatgaaccgctgtttgtagagggtagctatggctatcgtccgaacagaagtgcaaaagatgcaatacttaaggttaaggagtatgccgaacaaggctatacatttgctgtagtccttgatttgtcaaagtacttcgatactattaatcacgaaatcctcattgaccttcttcgcaagaatgttaaggatgagcgtgtagtacagctgataaagcgctatctgaaaagcggtgtaatggaaaacggagtagtcattgatacagaggaaggctcaccacaaggtggaaatctatcaccattgctggcaaatgtctacctcaatgagttcgaccaagaattcttgaaaagaggtgttccatgcataagatatgcagatgacatcgtgcttcttgcaaagagcaggcgagcatcagagagactcttggaaagcagtacaaaatatcttgagaagaggctgaaacttacagtcaaccgagaaaagagtcgtactgtcagtgtgtttgcaatccaaaattttaaattccttggctttgcattgggaaggaacggaaagggcatttatgtccgagttcatccgaagtcatggaagaagttcaagtccagactgaaggaactgtcttcccgtaagcgatgtcagtcaatcaagccaagccttgagaaaatcaaggtgtatgcgaggggatggcttaactactacggaattgcaagtatgaagaagaacatagatgacatcaacggatggctctatcacagaatacgtatgtgtatatggaaacagtggaagaaaccgaggacgaaggtacgtaatcttatcaatatgggagtaccaaaagacttggcaatgcaagcgggtaatacccgacggggacattggttcgcaacgcatacagttgcagtaaacatggcaatgacaaaagaaagactgataaacagtggcttttatgatttagccacagcctatcagtctgtgcacgtcaactattgaaagcgccgtataccgaacggtacgtacggtgctgtgagaggacggcggttagtcaccgcctcctactcgattccagcacgtaaaagttcaaatataaaagaaaatgacgggagaagaatatgcttacttacaatctggaacagagaaatgatgaaccgaaatattattatatatataaaatgatccgacgggatattgagcgtggaaaactgaaaaaaggagaaaaacttccatccaagagaagtctggcggaacacctcggaatcagtctgatcacggtagagaatgcgtatcagatgttaaaagatgaagggtatatagaaccgagagaacgcagtggatattatgtatgtgaaatacatgtaatcggagaaatgaaagagcagaatcagcaactgcatatgcttcccgagataccggaagaaatcgaagatggacgattgcagaatgcagcactttccagctttccatattccctgtattttaagaccgtgcgaagtgttattacagaatatggagaagaattgctgtatcgttcaccaaatgagggctgtgcgattctgcgaaacagtattgcatcctatctgctgcgttatcgtggattatttgcacagccggaacagattattatcggatcgggagcggaacatctgtatggtacggttgtgcgtattcttggagcggataagatttatggaattgaagatccgtcctatcatcagatccggaaagtctatgagggaacgggtgcggtctgtgaaatgctgcctatgggggaagatggaatcaggagtgatgtgctggcacagacaagggcggatgtgctgcacgtgacaccgtttcacagttttccgtccggggttacggcaaccatagggaagcgatacgaatatcttgaatgggcaagagaaaaacatcattttattgtggaagatgattttgacagtgagttcttcatgcctggtaagccggtagagacattgtttatgctggatgacagcagttcggtcatatatatcaatacattttctaaaagtctgtcaccgtccattcgtatgggatatatgattttgccggagagactgatggaacgttacaaaaaaacttccggcggattttcctgtaccgtaccggtattggaacagtatgcgctggcagaatttattaataaaggatattttgaacagcatctgagccgggtacggagaaaacaaaatcataaaatggaagtatagggttgacagatttatatgcagattgccaatcagtttcggacagatatcctggccggtaaatatgcacagggagaatatcttccatccatcttatatttggagccggaatgcttttggaaatcggactgcatttttttatcccaaagggattcattcatccactggtggctattgtggcagatattgtactggttctgaccggaggagtgatacagtatggacttatgaagctgttttataagtttccactgtcaaaagtagcttttggtgcggctatcaaacgggaaatgaatgtataaatataaatgaaagcatatgaagaaagtaaaagagccggtcgtctgaccggctcttttgaggggagtataaataattaataagaggtataacattgaaaagaagaaaaaacttcttttcaaaagttattataatggattgcggtatggattgcaatcaaataatgaatattttctcgaaaagttgagaaactattcctgtactaaataattgtattcgttgaaccatgcagtttttggggaaacgttaaaggaggaaaaagtatgtcaaaaaacagtacaggaacaaacagtgcaacaaatcgcagcggaagtaatcgtgtctctgattgttattccaacaagtctgaaaacagaacatccaacaaatctgtgaataagacatcagacaagacagaagacagggtatcagataaggcaggagatgtgtctgattccgcatctgataatatgcgctaggcagaaacaaaatgcataaaattgcataatataataaaaaacagattacacgaaggacagcgtgtaatctgttttttgatgaaaacggcatattctggaggatattgtgaaagattttgaattgatttacgcatcgcagctgagggcaaaacaaagggagagcagggcactggtaattgatatccgtgacaggaaagagtatgagagggaacactggccgggggccgtcagctatccgtatgatcagctggaacaaaaaactgcccgtctgccgaaaaaccgcaagctgattttgtactgcgaccatgggggaggaagcatgcagatggcgcgtatgcttggggaacaggggtatcatgtggcaagtgtggttggtggttatgaggcgatgaaaaaaatttcgaaaaactattttaaaaatcgtgagaatatgtaacaatagaactgcagaccatgcaatacattatagtagaaaagagaacatttatggatacatatgaattggttgtaccgtgtcattttggactcgaggcggtaacaaaaagagaaatttatgatttaggatatgaaattacaagagtagaagatggcagagtgacatttgcgggagatgcggaagccatatgccgtgcaaatatattccttcgcagtgcagaaagagtgctgttgcaggtaggacgttttagggcaacaacatttgatgaactgtttgaggggataaaagctctgccttgggaagactatattccaaaggatggaaaattctgggtaaaaaaggcatcttctattaaaagtaaactgttcagtccgtcggatattcagtcaattgcaaaaaaggcgatggtagagcgtctgaagaatgtataccggctgaactggtttccggaggatggagcaccttatccggtacgcatttttctgttaaaggatgaggtaatggttacactggatacttccggggattccctgcacaagagaggctatcgtctgatgaccagcaaggctccgctgacggagacgctggcagcagcactgattatgctgacaccgtggaaaaaggaccgtattctggtagatccgttttgcggaagtggaacgttcccgattgaggcagccatgattgcagcaaatattgcaccgggaatgaaccggcagtttaccgcagagcaatggaaaaatctgattccgaaacagttgtggtatgacacggtagaagaggcacaggatcttatggatgcagatatccaggtagatattcagggatatgatatcgatgcggaagtggtgaaagcagccagagagaatgcaaagcgtgcgggcgtggatcatctgattcattttcagcagagagcggttgcggatctgcatcatccgaaaaaatatgggtttgtcattacaaatccgccgtatggagagcgcctcgaggagaaagaggatcttccggagctgtatacgcagatcggacaggcttatgcaggacttgacagctggtcactgtatatgattaccagttatgaggatgcggagcgttatataggaagaaaggcagataaaaacagaaagatttataatggtatgataaaaacctatttttatcagtttatggggccaaaaccgtcgaaacgcagagaagcagcagagaaaacgatcgaaaggaacagcagtaatatatgaaatactcgaaacggtatattgcgtttacaattgtgctggcgctggtttttattttaaaatttcagattctgggcgtggacaatgcacaggtgggacggttccgcggaggagaactggatacacaggtatggaatccgatggtggcaaaggaagtcaacgggcagaccattcatgccgtaatcgataaccagacttacaataacagtaaatcgaaattttacatggacaaaaaccgtaatattatggttcctgtcagcatgttgcgggatgcgctgaattgcagtgcacatgtgtacgataaaaaacgtcttctggtggaaaaacacagtcagtccgtatcgatggatgtgggtcagaaaaaggcgtatttaaatggggatgaagtagatatttcatccgctttaaaggaagtcagaggccagctggttgtcagtctggaagatctgtccaacctgttaggttacagttgcagtttcgatatcgcaagtaataccattacggcatccgataaagatacttctgcgattgttccggcttcctatgatttaagggagcgtgaccgggtatcaacgatatacaatcagggttcctatggtacgtgctgggcgtttgccgcaaccagtgccttggagtcttccctgcgatcggaggaaaaagttaatttttccgtggaccatatgagtatgagcaattcttttcatgccaatcagtatgatggcggagaatataccatgggaatggcttatctggcagcatggcagggaccggtctatgagaaggacgatccgtatggggacgggatgacggatgattcgctgaaagcagtgcgtcatgtgcaggaaatgcaggttattgacggtaaagattacgaaggaataaaagaagcggtatttaaatatggcggtgtggaatcttccctttacagtaccataagaagttcacaggggagttcggtgtattataatcagaatacaagtgcgtactgttatattggtacggaaaaaccgaatcatgatgtagtgatcattggatgggatgacaattattcgagatccaatttcaatactccgctggagggagacggtgcgtttatctgccagaacagctggggagatggatttggagaaaacggaattttctatgtgtcctactacgatacgaatattggcacgcataatgtggcatatacgcgggtagatgatgtacataattatgatcacatctatcagagtgatctgtgcggctgggttggaaaattaggatatgacagtgaccagatttacggggcgaatgtgtttgaggcaaaagggagcgaaacattgtctgctgcttctttttatgcgaccggtgcaaacacacagtatgaagtttatgtggtgcacgattttgaaaatgagaagtcttttgcgcagagagaacagcttgcatccggaacgttacagaaagcgggatattacaccgttgattttgatacaaaggtttctctgaaaaaaggggaacgttatgccgtgctggtatacctgaaaacacccggaaccaaacatccgatggcaatcgaatatgataccggagagaaaattttacagggtgtggatctggatgacggagagggttatatcagtttaaatggaaaaaactttgtaaacgtaaaagagaaaaaggattgcaatctttgcattaaagcatttacgagggattaagatggacgaaatcgttttaaagtgggtgacagtactgtcgggaatcctgacggtgatagtctgcgtgtcggttttctttttcccggatatacatgaacgggctgttctggcagccgagcagcaaaaggaagtcggcggaggaaatctgatcgctacaacggcgaacccgaaagcggtggtggagcagtcaaaggatctgaacgcgcagcttaagattgctctaccggagggaatttcaaaagcagatgtagaaattgaaaatgattatgtgacgcagaccatttatatcaaatttgcgggcggcgtggatgattatttcgagcagtatgccatcaagggaagcagtgatcatatagcatccatggcttattataaggataaggaagagggcgtgatcgcacttcagctggatcaggtgtatgaactgaaaaaccggttcaaaaagggaagcctttaccttgattttattgatccgcacgatatctatgataaagtcattgtggtggatgccggacacggaagccacgcagcaggtgccgtaaaacttggaatttctgaaaaaagccttaatctggcgatcgtgcagcagttgaaaaaactgtttgatgaggataaacgcaggatcagggtgtattatacacgtacatcggatacgaatccgacgctggatcagagggttcagctggcaaataaggcaaatgcggatctgtttatcagcgtacataacaattcggatgcaaccggaaactttaccaaagtgaagggaacccaggtaatgtacagcgaatcggatgacgcaaagctgtcgagtaagaagctggcggagatttgcctgaaaaatgtcgtggatacgacgggcagtgagaaccgggggctgctaaaaggagacagtatctatattatccgcacaagtaaggtgccggtggcactgattgaggtaggatttatgacaaattataaggaactggatctgctgaacagtacaagttatcagaaaaaggcagctgagggtatttataacgcaatcaatgaagcatttcaggagggatattaaattgacagagattatttttgcaacgggaaacaaggataaaatgcgtgagatccgtgagattatggcggattgtgatgtacatattgtatccatgaaggaagccggcatcagggtggatattgtggaagatggaactactttcgaggaaaatgcaaagatcaaagcacgggcggtggctgcacatacggatgcgattgttctggcggatgattccggactggaaatcgatgcactgaataaagagccgggcgtatattctgcccgttatatgggagaggatacttcttacgatgtgaaaaacaaaaatctgattgaccgtctggatggcgtaccgaaagaaaaacgtaccgcacgctttgtctgtgcgattgcggctgtccttccggatggaagggaactggtgacccgtcagacgatggaaggatatatcggctgggaaccggaaggagaaaacggctttgggtatgatccgattttttatcttgatgaatacggatgctcatcggcagcgatttctccggaacagaagaatgcggtcagtcacagaggcaaggcattgcgtgcgatgaaagaattgctgaaaaaagaaatttaaaaaagaatgaaacatttttaccatctgatctgtatagtaagtagaacagcaaaaaagctgtgacacacatacggaaaggatggtaatttattatgaaaaagaaactggttgtatgtatattatgcgggatgatggcaatgtcggcgttgacctgtggtattggcagtgtatttgcggcggagagtccggaaacaccggtaatttccgcacaggagggagagcagattccgaatccgtggaaggaatacacttctgtgaaagatgcagaaaatgcagtgggattttccgtaaagcttccgaaaaagatcagtggttatacaaaagatatgattcaggcagtcgacggattagttctgcaggtattttacaaaagcggggataaggagattttaatccgtaaggcgctggtatcacagggaaaagatatcagtggggattacaatgtttatgatgtgacaaagaaagtcctggcaggagcggctgcatgctgcggccgctgactgctggcggatatgcagacagcatctgttgcagatggctgtaaaacaggagaaacaggatgagagggcagcggtcaaccagaaagcggaaaagcttctgaaagattacggaaacagtattttgcggatggcatatgcttatttacataacatgagcgatgcagaggacatcctgcaggagactctgatgcaatatctgcagacagcgcctgttctggagaacccggcccatgagaaggcatggcttctgaaagtggctgccaacctgagcaaaaaccggattgattacaatcgtatccggcagaccgatgagctggaggaaacgctcgttgcagaaaagcgagaagatctgcgttttgtgtgggaggcagtacgcgcgctcccggaaaaataatattgttccgatgcggctggcacgtcgtattcttccgtttgctgcatgtgtagtgattgttgtggcggggcttgcagttccgcagatccggcagaaaattccgcaaaaaccgcaaaagccgggagaagaaaaaccggcggtagagggcgtatatgcgccacaggaggtagcatcggccgaaaaactgacggatgcggtgggctttccggtcagggatattgcttcgctgaaagaaaaagcaacggatcgttcctatgtgacatatggggatggactggcagagatcacatatcgctgggattcacaaagtatctgtttccggcagtcacaggggcaggaggataattccggtgactatatgcactatgcagaagaaaaattgattgttgtgggaaaatattctgtcactttcaaaggacaggaaaaaggcagttatatgcttgcaacctggtcggatggcacatattctttctctgtatctgccacgcaggcattggaaaaagccgagtttctggggcttattgaggaaattgaaaaaaatatttgaaaaattcaaaaaagttgttgactttattgccaggctatactataatctatcttgcgtcacggatgagacacaaacaacacggacgcaacaacatagccttcggggtgtggctcagcttggctagagcgcctggtttgggaccaggaggtcgcaggttcgaatcctgtcaccccgactacatgcgggtgtagttcaatggtagaacaccagccttccaagctggatacgtgggttcgattcccatcacccgctctgatattgcgaaagcgatattgatgagtgttcgtagctcagctggatagagcaacggccttctaagccgtgggtcgggggttcgaatcccttcgagcacatgcgcgttcctgcgagcgatgttagcgctctaaatggtacgataacatctctatggtgggtatagcgcagttggttagcgcgccagattgtggctctggaggcccagggttcgaatccctgtatccaccctgttgcggtagcaactatcattgttgggctatcgccaagcggtaaggcacaggattttgattcctgcattcgttggttcgaatccaactagcccagcttgcttaaaaattaaattatgggatactagctcagttggtagagcacttgacttttaatcaagttgtcgggggttcgaatcccccgtgtctcattagaaagaacttactacgatttcgtggtaagttttttttcttttgttcgtataactatctcacttaaattcagcagtcaagtacacagaaagtgaggtagtttcaatgaaacaaatccaaatgaacaaatctaaaaatttatctgtagaagacgcttatgatttatttatccgtaagtgtcgtgtcaagaatttatcccaagcatctattgtgtcatatcagaataagatacagccgtttgtagattattgtaataattgtcttatcagtgcagttacaattgacacagtggatggatttactaatcatcttaagacagaacataatgtgaatgatgtatctgtcgtatcatatttacggtctgtgagagcatttctttactactgtatggaatgtaactacatgaccacattcaaaattcatcttcccaaagcacagaaggacattaaggatatgccatacttgtttgtgaagagttcagctgccttgaatttcacatgaacagggacacgatcagctggattctaaaaaagaatacaggaggtcgctatggagaaattggaaaaacggattcatgatgacagcaatggtctggactatgttctggtcggagactactacataccagacttgaagctgccggaagaaaaccgtcccattgggcgatggggacagatgcacagggattatctgaaacagtaccgcccagccctatacaatgaactgcttttggcgggcaggctctggacatatctggcagacctgaatgaacaggcacagaatcggttagacaccatcatggaacagatgaaagctgccgaaggtatcactgaggaattgaaagcccatgaacagatagcatgggtcagagctgtcaataacattcgtaaccgggtagaggaaattatcctctcggaattggtgtacggaaaggagccgctatgagataccgcattgaacgaatagaaggtcaacattgtcattttgttaatgggcggaaagaacttcttgcctatttgaaacacacacaggcgggaaccatcacagacatccgcaagatttatcagagcggcgttaccgattctgtcatggaactgtatctgccgtatatgaaaaaatagaatgtttgttataccaaaacagagtattttttgaaccactcactgaattttccagcgggtggttcttttattaccgctttttcttcttgggaacaaagtaaggctgcggcttcgcctttcccctcttgctgttgggatttttcaacagctttgacaggctcagtatccgtaggaacgcagagaagtcctcggaggagattttttcaaacggtatcatcatctggtcgcagaactcatgaatcatccgttcttcattactccccagctgcatcgtgcgttggaacttttcctgcacttgcgtaagcgttggctgcggatcggcggttgtcgggtcggtgacatgggctttgcgtatatcacggacaatgctgtctaaatcatcatgtatcgtatgatggaagaagtcactttcctgaacctgccctacttccagtgtacggacataaaggtcatcttctcccggagcatggctgtttaggatttcctgccgggcagcttccagtaccatgttcatctgctcgacacgcatatccgcaattcggtcaacaaaaatttctatatctgccatcagccgccggaagtttgggtgtgtggcaatctcgcacaaaagccggttgttgatggtgccgctgcttaaaagttctaccatatcatcgctcagatgcagagcctgtagctctgtgtttgggtgatttttattttccgtcagccccatcaggtagtcggtggacacgccgtaaaattttgccagtgttgcaatggcaaaggggctgatgtccttataatcatcgttttcatatttccccagagccgatttggataatcccgtctgctctgccagtttttccagtgtcaggtctttatttactacccgaaggtcttttaaccgttcttgaatggaaagttttacgtgcatcgaaatgccccctttttatcaggaaaatcctgttgctatttaccattatagcacgtttccataagcgtggaaatatggcgtttttgtggatttttccatcgttttggatatacgggagaagccctgttttttcggtagaatgattcttgtcaacagacaggaaccttgaaaatcgaatgaccggctgcatgatgtatgacctttggggaagtgacgccatgacaggagcgcaccaaaaaggacaatacgccggtggggagcgtacccgcttgcaggagcagattgcagataggaaacggcaaagaagattgtaacttatgcggggtttgccccgctgtaaatagaagctgcgtaagcggcttctccatgaaatgacaggaggttgatttttatgaagttaagtatcagggaaaagaaagtgctgtatgcgtttggctgtcccaactatcaaaacacagtcacaaggatgaaatggctcacggcgcttaccgttgatccggaagcaaagcgccggatgctggaacttgcccggaagctggaaatggaaaccgatgaaagctggtacaactgcttttatcatcatctgcgggctgagatggatgagtattaccgggcaaaacgctgtctgcgtgtagtcaggaaaagcaccgattatgaggaggatttttatgattacgaggatttttatgaggaagccgtctaaatatgaaaaagaaaccattatcaacttcaacgaagcggaggacaccgccaatatttatacgttcaacgctgacttgaagcgtcgtctggctgagttcagccggaaataccctttgctgtgccggttggaacacagtaccgctgaggggagcgtgacttacgtgatggacaaatcccgcttatctatccggctggtgccgccgtatagtgaggagcgcagagccgccgccagagaatacgctaaacaacacggctttcaggttctgcggacagagaaggaaagtgcctgatatgggtgcgttttacggtaaaacaacgggtctgcacccagcatttttatcgtgaagatgctaaggggtactctgtaccgtctcctatgtaaaaccggcacatgaagcgttacagagccggaagagctgacaaaagcctccgcagagggggaggtcagcttttccgggctgggtacaggggtgcagcaccctgttggggtcaaggggcaacgcccattggctggggtgagggacggcagttcccatcgggtcaagggtgaaacgccttggcaggtcaagggcggcagccttgcccagtgaattggcgttgcgccgattcgtactgggtattacttgtcgcaaaactgctcaaggaatcggcttcgccgccactcccctgtcggggaaagaaaaaagattggagggaaaaacagaatgaaactgacacggcataacggcaggtctgggaaacatggcacttataatccgaagcacaatgaccgcagctttgatttggaaaacagtgagcatatcaacgcagagcttgctaagaaaaatgtgtattgggattgctacaacggtttccgtaaccttgccaaagaggaacttctggcagatacatttgaggaagttgaggaaatgtattattcttcccattaccgcagttatgtagaagcacagaatcagaggaacgaaaaaaacagacacccggaacgaaaccgcacgacttcggatttactgaaaaataaaaagacagcgccagaagaaactatcttccagattggaaccatagacaaccatgcaccgccggaagtcctgcttctggttgtgacagattttctggctgagatggaaaaaaggtttggtaaacatgtccatatccttgactgggcgctgcacatggatgaaggtacgccccatatccacgaacggcacgtttttgattgtgagaaccagtatggggagcttgccccgcaacaggaaaaagcattggaggaacttggttttgaacttcctgatcctgcacagaaagcagggaaaaccaacaacagaaagaaaacttttgatgccgtctgccgcacattgctttttgatatggcaaaaaaacatggcctgcacctggaggaagaaccggaatacggcggtcgtgcgtatcttgaaaaacaggactatatcctgatgaagcagaaacagcagatggagcaacaggagaaaaagctggaggaactgaccgttaagattgaggacattgaaacgctggtagatgaagttgctgatgttgcctacgataaggcagttgaggttgtgagcgataccgtccgcatggaaacccataaagaagatattcgtctgattgaagaaacacaaaattggctgcgctcgccggagcgtaaagcaccaaagaaagagcgtgactatgccattgaccgattagacggtgtagtgaaaaaaatcagaaattccatgcagaatacgttgcagaaaatccagaccgccctgatgaagccgtctgctaaaaaagccggaaaggaacaaatcaaggaaaaaacaaaggaatccatttattccaagcttgcaagaggaaagatttcggcagacgcagccaatcaggctcgatgggaacagcaaaaacggaagcttgggaaaaaaagggacatggagatttgacaggcacttattgttttcattttctgaaacggtcagtttcttttctattttgtgaggtgatttagagatgaatgtatttgaagctgtgaagcagtctgtcaccgcaagacaggctgcggaaatgtatggaatcaaagtcaggcgcaatggcatggcgtgctgtccattccataatgataaaaatcccagcatgaagctggataagcgttaccattgtttcggatgtcaggcagatggggatgcgattgattttactgcccgtctgtttggtctgaacagtaaggaagccgccctaaagctggcggcagattttttcattgtatttgatgccaaagggcatgacccgccggggagaaagaaggtcaagccgaagatacgggaagaactgcgataccgtcaggcagaacagaaatgtttccgggtgctatccgattattaccatttactgtgccggtgggaacgggattatgccccaaagaccccggaggaggaatggaatccgttttttgtagaagccctgcaacaaaagtcctatatcgaatatctgctggacagtttactgtctgacaatatcgaagaacgggcgtctgtggtggcagggtatggaaaagaggtgaggaagattgaacagcgaatatcagagtttaccgccagtcacccggcaggcggtgatgagcgccgccgatgccatgctgccgccccggagcgttgaggagattcgggaaagccttacggtgacggaaaagggacagacggcgaacaccatcgggaactgtcagactgtattctgtcaagacccgcttctgaaaggcgctatctgtctgaaccttctgactgaccgtgtggacattgtgcgggatctgggctggcgcagaagtaccagcgccctgacggacaccgatgtgaaatatcttcttctttattttgaacagaactatgggctgaccagtgaaaagaagctgacggcggcgctttccattgtagcaaatgaaaactgctatcaccccatacaggatgcgttaaatgcccttgtctgggacggacagccccggattcgttcctgtttgcatcattttctgggggcagaggtgagcgattatgtggaagaaatgttccggcactttcttctgggcgctgtccgacgggtattccaccccggctctaaatatgaggaaatgctctgtctggtgggcggtcagggggcgggaaaatccacctttttccgtctgctggcaatgaaagacgagtggttcagtgatgatttgaagcggctggacgatgacaaggtatttgcaaagctgcaaggtcactggattattgagatgtcggaaatgcttgccaccagcactgcaaaaagcattgaggagatacgctcgtttatcagccgtcaaaaggaaacctatcgaatcccctatgaaacccagccaaaagacaggctgcggcagtgtgtgttcggcggtacttccaatacgctggattttctgccgctggacagagccgggaaccgccggttcctgcctatcatggtgtacccggaggttgcggaggttcacattttagagaacgaatctgcttccagagcctatctgctgcaggtctgggcagaagccatgagcatttataaaagaggcaggtattccatgaaattcacaaaagagattcagaagcagctggtggaggtgcagaaagactttatgccggaggacacggaagccggacagattcagggctttttagaacattattccggcagcatggtctgttccaaacagctttttaaggaagcgcttggacggacgtttgaagaaccgaaacgctggcagcttcataacatcaacgagattatgaacacagtggtgtcaggctggaagccattttccaaccctcggatgtttgccggttatggtcggcagaggggctgggagcgtgaaccttccggcaacgaactgcccggcaacgaaagcggatttgtagaattgagtgaggaagaatgccgccagctagaacttccaaaggagtggattgcctgatttgtggcgttggttgcagggttcattgtcagttggttgccgactttgttgccggggattttcgggtctggatgcggaaaaatcctgtaaataaggtattctttcatgagtatctatatctttggcaacgaaagcaacgagatttgataagaaaataagaaaagtaagaatggaaagccagggaatagagaatatgttttttgaggttcgttgccggacttcgttgtcattccctgttgtctggctcaatgtatcatggaggtagcttatggagaaaaatagaaaacaaaataaaaaggtacagtttatcgtggtgcgggagttttccggggaaaagcccatgcgggaagcctttgaggaactgatcgagcgtcagacctgcggacagtttgaaaaatggcggcagcatcgggaaacggcagaaaaagctgcgtaaaacggttgaatcagggacagggacatggtactataatggtatcgtgtccctgttcatagaaggagaacactatgagcaggaaaaaagaaataaaccagaaaatcacggctctctactgccgcatttcccttgaggacggcggtgataatgagagcatgagcatcagtaatcaaaaactgatgttaaaggactatgctgaaaaaattggtctgtttcagcatgagtattatgtagatgacgggtacacaggaaggaatttcaaccgtccttcgtttcagcgcatgattgcagatattgaagccgggaagattggctgcgtcattaccaaagacctttccagacttggcagaaattatattgaagccggaagttatatcgaaatctttttcccgaaacaccgtgtccgctatattgccattacggacggtgtggacagcctgacccgtcaggagatggacatcacgccgttcaagaacatcctgaatgacatgtacagccgggatatttccaaaaaggtgcttgcaggacgtatgacccgttccagacagggaaagttttgcggcgggcagccgcccttcggtctgatgcgtgacccggaggacaacggacatttaatccttgacccggacacagcgccggttatccgaaaaatttatgacatggcgctggatggcttgggctgtatgcggattgcaaagcagctgatggaggataaaatccctatcacaagggtaaagggagataccgcctgtgatgtaaactattattcatggggggcttccagaattagccatatcttgaggaatccattttataagggcgcacatctggtctgccggacacaccagaaagggattcgttccaacacctatgacattatcccacgtgaagattgggaagttattgaggactgccatgaggcaatcgtatccccggaggaatgggaacaggtgcagaccattattgaccgcagaccgcctgttatgaaaggcaatgcctgtcctttttataacatttttcacggcatcatctactgtgctacctgtggaaagtccatgcaggtgcggtatgaaaaggtgggcagaacctcaaagaaccgttttaccggcgaagaacgggaacccattgataaggcatactatatctgccagacctataaccgactgggcaaaaatgcctgtagcagccacaagttagaagcaagggatttatataatcttattttagcagacattcaggagctggcaaagaccgcacttaaagattccgatgccttttaccaccggctgagtagccggatggaacgccggtatatggcagatatatctgaaatacagaaagaatgtgaccggctgactgcacgaaatcaggaaattgacgctatgtttttgagcctttataccgacaaggcaaagggtgtactgacggaacagcggtttctgaagctgacttctgctatggagcaggaacaggaatccaaccaaaagcgtctgcgtgatctgatggaaatgatgcgccactctgacgaacaggaaagtgatgttaaagcatttatcaaggaaatccggcagtatgccaccattgaggaactggacgaggtggtgctgcaccggcttatccataagattctggtgggtgaggtcaaaaagattgacggtcagaaagtgcaggaagttaagatagtctataattttgtaggtgaaatacctgagataatagaataataaaaagtagctcttctcctatgttttggagaagagctactttagttattttttaattactaaatcgtatatcgtaacacttagtccggccaatccaaataggtggaatcaaccaatgtactgccacttgctttgaatgtatccaggaaagtacaatcttttgaaatattcaagcattcccacaagtagtttatcgtacctttcatatggatttggcaaaattgtttattacttgaaatttcgctccatgaatagtttggttcccatgatcccaatgtaaatcccgtatcataagaacttccaactaatgaaacacttgatattttagaagaacttactgtggctttgaaatcttgttttatatatccccaaccaatagctggaatcatactctcgacactggcagtataagtgccagttgcgcgtgttgtaggtagaggagtaactctaatagacatactatccatagcagttttcatcatttctacataagagcgaacagatgcttctatctcagcatcgctaatgttatcattgattggcgtaatatgaaaattttcgaaccttacaccaattccattttcttcagcccatgtattcaattcttcagcagcgtacttttctgcattaaactctccatttgtatctgctgcaaacactgtcattgatgacgcaagtatcagacatagtgatattaagagagcaaaaatttttttaacattatgtttcattacaatacctccttttttatagcttttctgattttcacagctaatgcaaggattaacgtataaattaaatatgtaataaacacatctaaaagaaatgttcctataccaaaatgtattgcaaaatcatcgcgtgcataaatggtatagaatttatacggaaatcccaaccataaagcatctgacattgtttcttgtgtaaaaggaatgtatgcaagaaacaatgtaatacacagactatgaattagcctctgtatgttccaaaatcttttgatattgctcacttcctttcacaaataacccaattaaaccgttgctttttattttcttttctctccaacggaatcacccctttttcaatatttcattatgcttaaacctatttatataatagcatatttttttatttcattcaatagaaaaaaatgattataggacatcttgagcttttaagaatatcttcaattcatcacttgacattgtggcaaagaaacttactcgaatgaacagttggagaaattattagccaagccagacctcaatagttgctcttttacggagtttaagacatgggtatttgaaaactatatgcttgctacaggaaatcgtctcagtacggctttaaacgtccatatcaaggacattgactttgataatggaatgattatgctgcgtaagacaaagaaccgtagacagcagttaatcccactctcagcgtctttatctgagatattgagagagtatcttgatattcgtggtggaaacccagacgattttctcttctgtaataactatggtgagcaagccagcaatagaacatggcagacattggtgtatcgctacaacattaagcatggtgtcaatgtcacgagtatacattcatttcgccatactttcgcaaaaaactggattctctcaggtggtgatattgtaagattaaaaaccatacttggacacagtaatatagcagtcacgaatgaatatcttgcaatgttcggacaggatttacaaatggattttgaaaagtttaatccgcttgataatttcagcaagaaacagaaaagcacaattagaatgtaaaggagagatttggatgaagaaatatgttagatgcgaagacggaaaagtttacagtggtgttatctatagcaatggtacaagagttgaattgccaataaacaaagatggcactatcaaatggtttgacgataaaaagttggttaagaaatcagcataaaaacatagtgtatttcccagtgggtcaattttactcttatttggggtaaaattgacctttactggtgggtcaatttatagagtaaatgagcataaattggaactcttataactaatagatgagagaataactaaaagataattgtttttgccctttgacaagggataaacacttgggattaattaacagaaaggagaatataatattgaacattaagaatataaatcagcgtcagtttgacaaaacgatgttgagggaaggaatatctgttacagattattacgatgtcaataagacgtatgaagtattctttagacgcaataatcgtagtagacgcaataatcgtaatcgtgacacacagggtaaattaaacctattctatgcacagagtacacctattacgataggaacgattttcgtattgaatggagagaattatatagtgacatctcaggatggcattgaaagtgatatatactccacttccattgccgttaaatgtgatacaacctttgttgttcattctgataaggagaataaatatatagatgttcctatgtcggttatgtcagatgaatggactgtttctaatggaaatgtattcaatatggttaatggtgctgtggctatgtttacacaggataatcctgttgcaagaggtattgctgttaataacaaatattatgcctttggtggctattattctgttggtaatacattctataataatggactggcttatttctatttggagcgtcagacaatgccacaggacaattataagaccgtatatacaggtgttaccacattggatatgaaggagagtaccacatatcagttgacctatgttgtgaccaacaatgggaatgttgtggataatccatctataacatattcatcttctgatgaaactgttgctacagttgatgagaatggtcttatgacattgcacaaagagggtacagttaatattaccgctaactcttgtgttactacaatgactataactaatactggctctaaggtagattattcaatcagtatctcatctacaaggatttgaccttgatggtatccattatgttagatggaaaaggtcaggcggttcagcaagaaatggtaaatgctattttgtgaatgaactctttgaaaaggaattagatgaatttagtgattgtggagttgatagaacaaagccacaagaccttgcaagcaacgaagcatacagagcattaccattatcatccaaaatagatgatataaaaatcagaccagagaatatcttggtaatcaatgattgcgagtcagaatttgaagaaaaggttatgcttacgaccttaaaggaagtcagagataaaaaaggtaagaaatcaatgagattgacaaccgatgttgcagagaagcataaggtggtaaataaaatccatgatggacaatctctgatagataaatccttaatgccagagaaatatcagagcaaaggaatgttattactaagacatatttacttcaagagttgttgtttcaacgcaaacattcagcaatggtttaaggataatggaataacagatgtatcacagttgaatggacttacagttgcaaaggatattaaggatataaagttaatcacaacaccaagcagtatcaaatatatcaagtttggcggtgatgattggtttactgaatggttacaggcggtacagaataccaagaaggatttcggcattgtaaaatatgagaagccaacaaaatactttgatggtgatttcgtaagaacacattaccagatacttaattccattcagttagagattgaagaagtacagaaacttgcagtacattcagtggaatatctccatagattgagaacagattacattgcaatgttgacctactgtatggagcatgaagatgatgaagatacagatttaagattaaatgcaaatgcagatataatctacagattaggcaagaacaacatcgacttcaaagatacagaatactattcaacacttgcaaagaatattgtagagcagttgagaagtgatattaagattggcagaatacttgtaagaggtaactactccaccctgttaggaaatccgatagaaatgttacaagcatcaatcggcaagtggaacggagaaagccaagtaggaataggaaacattgtatcaactgcatttgaaccaaagaagttacttgcagcgagagcaccacatatttgtgcaggaaatatctacttgccaacgaataccaagaatgagttggttgagagatacataaatctcacagataacattgtagtaatcaatagcatcggagagaacacattgcagagattatcgggtgcagacatggacagtgatgtgttcctgctaacagacaatgaaatccttattaaaggtgcagaaaagaattacgataagatgttagttcctacaacagatattgaagcacagaagaagaaactggaatacacaccaaagaaccttgcaaagttggatcacgacacagcaaagaaccttatcggtcagatagttaatctctcacagatctataatgttggtatgccgattgctactaatgaaatgattgctaatctgcaagcgttaagagagttaggtgctataagcattgagagtgtcatggaaaagagtgacattgtaactgatgttgatgttgaaaagaagcgtcttgcaagtgagggagatgttcagaaacataaggaaaatcaaggggataatcctagtaaagaagtagggaataaagaagatatgaattgatggaagtgaaattggcgtctatatgtggtgtttcaaggataatatgcacactatatatagtacgcatttccctttttcatcaggcatattggttagagcgtgtcaaaactggacaaattggcaaaatcagtgataaatttggtctgctaaaacaggcactaatattacactattatggtacgtttctgagagtgcttcggtgttttcgtagaatatggtcttatatgctaggtggtgctagaatataaatagtacaagccaaaatgagaaattccaaatacacataagcatggtacaatagaaacatgctgaaggaggatctcatatggcaaagcaacatgacaaacaatttaaacttgatgcaatccagtactatcaagatcataaagatctcggagtacgtggatgtgcagaaaatcttggcatcggctacagtacattaacaaagtggctgaaagacttccgagaatcaggtgatattcctgttcgtggttctggtaattatgcatctgatgagcagaaggaaattgcccgtctcagacgtgaattacgtgatgcccaagatgcacttgatgtgttaaaaaaagcaatcaacattctgggaaaatgacggaagccatttatctcgaagtgactgagaagacagaagctgcccaaaaggctggacgccaggtttccgtctccggaatgttgaaatttttaggcgtctctcgctcaggatatcttgcatggctccaccacgtaccttctgatacagaaaaacgtcgtgaagctgtaaaagcaaaaatacaggatatttatgatgattccaagcagaactacggcgctccgaaaatcactgtagaactgcgaaaaaccggtgaagtcatttcggaaagaaccgttggtacatatatgcgccaaatgggaatccgtgctcagtggagcaaaccatggaccatcaccacaaaagattctgatttcagcacagaattacaaaatatccttgatgaacagtttaatcctgaccgcccgaatgctgtctggtgttcggatatcacctacatctggacaatagacggatttgtctatctgaccagtattatggatttattttccagaaaaatcatagcctggacactttcagaaacactggaagtatcctgcgtgattgatactataaacaaagccaaagctcgccgaaatattgatcaaccattaattatccattcggatcgtggcagccaatatgttgcaaaggaatataaaaaagcaaccgaaaatatgcagcgtagctactcgaagaaagcttttccgtgggataatgcatgcattgaatcctttcattctgttatcaaacgtgaatggctcaatcgctttaaaatccgtgattataagcaagcataccagttgatttttgaatatctggaagctttctacaatacgaaacgaattcatagccattgcaactatatgtcgccaaacgaattcgaacaagtgtatgaaagaacgaacactgaggctgagcttctggcaggttaaaatggagagaaatttctcattttaacttgtactaaatcttgacataggaccaaggtgtataagccgataaaagagagattttttcggtttacattcacttgactatcaatcaagtgaacgttataggggtaaaatacacaaataatatacaaaatatagggtgtaaatcgtactatttttgtgcaatatgctaatgtaccgtgtgtattattggttgcccctactaacgaataatatatatagcaaatcacaaaaatccccacagccaattttcaagggtatatctctaaaatatatccttatatcagatacttctaaagtacccagtataggtagggtatattacacattccatcttatgcaaggttcatttgaacctatcaatcctgcgtcaaatatgtttcaccttccaattggactaattcagatatgcacacaatgcacttccaaaacaggacttgttaattctttgttgccattattttaatatgagagtataattaaaaaaatggaggaggatttgtttatgaaaaaagcaaagagaatattaagtttggtaatgtgtcttatgatgattattgctattgttcaaataagaccacaaaatgtttatgctgctaaaaagattaaacttgatcacacaaaaattactatgtatgttggtgaaaaagaatatttgaacttgtatgataggaaaagtcaagtattaggtttaaaatggacttcattaaataaaaaagttgccactgttgataacgttggatgtgtaaaagcaataaaaagaggtataacaaagattgctgttaaatataagaataaaaaatatatttgtaaagttactgttaaagatgctttaaaggatcacgtaaattatgaattgattgacattccagaaaataaatataaagcaattaaaatcacgaatgataatgatgttgctatagcaatattttttaattacaaacgctatgatgaaaacggatttttccttcaagaagggtcggtaaaatatatagtaaatgcaaatgattatactattgcaccaatgttatatagtgaacacataaaaatagagagggtaaataaagtagattttgtcaatatggaatataatatttctgcaccatattatgataataaaaatcataaagaatgcagggatattatatttacttcaaaaaagagagaatctacagattattctatattgtattataataaaaataatgaattgattatgataaataatggttatgtttatgttcctgcaaatgaaagagtgaagaagacaatttcttatccaatagaattaaaagagaaatatgatatacaaagaatagagatattttttaattaaaaagttatgatatatttggactatggtttctgccgtagtccttttttaatgcaataaaatcaagatgccagaatggcactttgaaaaatgaaaggagaataatatgcaagtattagatagattaaaaatggagttgtcaaatcagcaatacttctccgatgaacaatatacccagttcctcaaagagaacgagttgacaccaactgacaactatgtaaaagccgatatgcagaaacaactattattcacagtattagatgtattagaagcagtcgcaaatgatattgatatcatgtcttccatatccacagaatttagtgatataggacaagcatatcaatttttagaggcgagaattggacaggtaaaggataagattgctgccattccagatgagaatgaggactatacttgtttctcgttgatgtatacgagaaatagaatttagcagttgacacatatggatttttagtatattctacaagtagttacagatagttatacgaaatcgtattaagaaagttatatgagtttcttgattatatgcgagttgcctacagttggtagagcacttgacttttaatcaagttgtcgggggttcgaatcccccgtgtctcactaggaagaacttgctacgatttcgtagtaagttttttgtttatttctccctaaatttattgcatcggaatttttactggatttaaagcaacaaggttaattcgttgaccttgaagaattacgtatggaagatcatggaaatacaagtgataatatgattgacaaaatatatttgttggaatataataaaatacgtagagaacaaattttttacagtcacgtaatttgtttagacctactaaaacaaggctttatgccgaaatcagaagcaccgatgggtgcttctttttttacttatgggggaaaatatggcattcagggtggtattgattgagaatgaagtaacaataaaagtgaaattaaataatctgattgttacaaaagaaggggagaatctatggataccattagatgatatttccatgatcgttatggacaatctttcatctatgctttcagcaaggcttttgtgccagttgtcggagcagggaatcgggttaatgatatgcaatcagaagcatttaccaacgggctattatagttcttatgataatcatagcagagcgtcaaaagtaatcggctatcagatagaaaaaagcaaagaatattatgaacagttgtggagaaatattgtaacagtgaaaattcaaaatcaatccaaagcatatttcagattgacaaatgatttggaaggaaccaggatgattgaagaattttcaaccggaatcatgaatggggataaaagcaatagagaagcacatgcagcaaaagtgtattttaatcttttgatgggaacttctttttcaagaggcaatgaagatattttattgaacagtgggctggattacggatatgccgtgttgcgtggatatattgcaagagtatgtgtgggatatggattaaacacgcagattggtattcatcataaaaatgaatataaccgatttaatcttgtggatgatttaatggaacctctgcgtccacttatagatattgttgcatatgaagttatgaaaaatgaaccgtattttacggcagagcatagacgacagttggtaaatgttttgaatatgaaaatattgtatagaaataaaaagatgtttgtatgtaatatgatagaaaattatgtggagcaatatgcttctttcatcatggagcgatgtgagaatattgtgttcccggatatagatgaatttgttggagaagaactggatggattataaaattatgagaatgttgtgtatgtttgatttaccggttgaaacagaggaagaaagaagggcataccgtatatttcgaaaaaatctgatgcaagaaggatttgttatgatgcagtattcggtatatgtgagagtgtgtccaagcagggaatatgccaatcggttggagaatcggataaagaaatttataccaagggaaggaaatgttagattgctgtgtgttacagaaaagcaatattcagatatgaagttgctggttggaagcccgtcaatagctgagacagtgcttggaacagagaggctgattatattatgaaaattgatgtaacagaatatgaaaagaaatatacgtttgagctgaaacctatcacacagttatgcggtcagaacattccgaagaaatcatatattttggaatccataagaagatattttagtgcatataagtattccgaagaacggaataagtggagaaacaatgttaaaatagatgatgaattagttggtagaaaattttttacggttttatcagtaagcggggtagtagatctgttgatgtggataaaatggtcgaagcaaagtttggtggtggaatatgtcaggggactcatgcaggaatttgactggcagttgcatttgcgcaccattcatggagaattggaagaaatgtttcagatgataaataaagatttgaatcatttaggagatattgaattaacctatgcggaatcggatgtatgggagatggttcaaaaatcgagcgttgttggaaatgaacaaacgtcgttggaggataaaaataattttgatttgttgacaatttttttgaatctggttgaaagtgtaatgggattaaatccaagaaaaatgttgatcatagtagagaatattgaccatttaattttgccaaaagagtatgatgagattttggagagaatgatacaaattggcgaaaaatacgatatatattttgttttgtcaacaagtctggaaggatatgtgtgctgtgacagaaaattgtgttcggggatcacggtactgggagaagtggattttcagatgccggaatttgaggatatagaaacatacgtggagaataattatccatgcaataagaaaatatcggaagaacaattgcagactgatttgcagaagatcattcaaaagataggacagggtggatatttatatacggtggaagaaaacgttatatgtaagctgattaatcaaacattgatgctgaatgataggtggaaagatgaggaaaaaatgcctgaaatggcttttttaaaagcttgaaaaatgatataatgaatctgaaaatgatggtatacaaaagtagggagtgctaaatttgatattttagtacctaaacaaattacgtgactgtaaaaccatggatccaccctatgagaacacaaagcaattttagtacctaaacaaattacgtgactgtaaaactaaagtgcatcaaggaagcaaacggagataattttagtacctaaacaaattacgtgactgtaaaacctgcggtaaatataaatgtggtgttattgattttagtacctaaacaaattcaatgtcacttagttaagctttttataaattaatggatttgtgtgcatctagcgtgaaaaggatgtggtaaacaaaaaaagattaaaacaatcttcattcaaaaaagatcatataaatatcaggcacgactttaagacagactttcgtctgccttaaaattagtgtatactagaattgtcagttactctatgttatacaaatcggtaagagaagctgattggtttttggactctatgctgtcgggcatagttcctatcgggcctgataggtaggatatacttacttatcaggctttctacatttggtggtgcgactcctcttagaaaatcaaaacagattttcattgcgagagaaaagttgacttggtactcatatttgcgattcctgctttttactggtacatgtaaaataattatggaacagaaattgtacaaaatgagcttgctccacagttcaaatgcaacatactctgtttttttagagtgtaaattagtagctccaatggtatgctttaggtcgcgaaaagaagtttcgatgccccagcggagattgtaacagtattttatatcgtccggtgtaaagtcttcttcggaaagtgtagtgataatattttcaaaaacaccatcggatacttcaacgcggacgattcttagtttcagcagatattcatcggaaatatcagctggattaagatagtcgaaagctatgtttttacaaatatagtggtattgtgattctttttcgggatgtttatgtttctttttagattgtgttctggtcagaatcagctctatggttgtatccagtttgtcaggaagagtcccgatgccaagaaaacgctgtacattcaaatccttagcacgaattaaaaaatcaacattattttcgattgcatgggcaaaaacgttgtaactggaaaatcccctgtcagcaatgaaaatgggggaccccccataggcataccgatccataagattgcagatagcttgaaactcatttttaagacgcccaggctggacttctaaatcaaagtaccgcttagaacatacctcatataaagagatggtatgaaccatattaaaaccggataccgatttaccatttggttcgtggaaagtatctgcatctttaagatttctggcaatgttaaattcagaaccatcacacgcaataagatagtattttccgcgaaatttttctaaggggaatttaaggttaaattccttgagaaggtgacggaatgcagaaacggaaagtttggaacgttgttgataaaaagcagagccagtaggaactgaggaatcatactcaaaaaatttgagaagttcatgatttaggcttccgctttccatagaaatgatcagatgcatcattttcttaaaatcaagtttgcgtttgcggataaaatccttatctggattttttacaaaagaagaaagtgagcgggacatctcatcaataatgtcccaaagtgtagttttgacaatttcaggaaatgtcataggtaaacctccttgaatcagaatgaaatatagttctaattcaagggccgctctcgttaccttaaaaatatatcagcaacgagagcggccgcacattttgattgatgtgtcaactataatttataaatttttgttagaggtttacctcatagtgaaccaataagcttaactaagtgacattgaaacaaattacgtgactgtaaaacgatcggctccatctcctaacaggtcattacattttagtacctaaacaaattacgtgactgtaaaacttcaagtctctgatgatccattgctaaatcattttagtacctaaacaaattacgtgactgtaaaacagaaagaacatatttccaatccaccgcgcattttagtacctaaacaaattacgtgactgtaaaacaatcaaattttcgtttgtaggtggtgtataattttagtacctaaacaaattacgtgactgtaaaatatgttgtggaagattaattttagtacctaataaattacgtggctgtagattaaaactaaaattagtttgaagatgagatttgtgaactctcaaaattttataagtaatggagcaaaaaatacccctgcatgaactgtcaaatacaagaatgcaggggtactttttataaaaaatatttgaaaccatttaggaagattagaataaatagttgcaaaataaaaagaaaaagtgtattctgaaataggaacaataaatttttgatttagaaaaagatattataacaaggagaaaagtatgcagtatattgtagctttggatataggggttgcctcagtcggttttgctgttattgataaaaagaccgaaaccgtaatagaagccgggtcaaatattttccccgaggcatctgcaacagataatcagatgagaagggggatgcgtcaggcaagaagattaacaagaagaaagagaacacggttagatgatttcacgaagctgtgggaggaatatgaatttgcaattccacaggttcaggaaaatgatattgttggacttaaagtgaaggcacttcgcgaaagtatctctttggacgagttgtatttgattttgtataactatctgaaacatcgagggatttcttatttggaggatgcggaggatgtttctgttagcggaacaagtgcatatgcaaatggattaaagctgaatgcaaaagaactggaaacaaattatccatgtgaaattcaaaagcagagactggaacaggttggaaaatatcgaggtcagatacagatagaggatgcgcagggggaaaaattggatttgagtaatgtgtttaccattggcgcatatacgaaagagattcagcaggtcttatgtacgcagaaaaactatcattccgaaatatctgatgaattctgtgaagactatctggaaatttttacgagaaaaagaaaatattatgaaggaccaggaaacgaaaagtcgagaactgattatggaagatttacaacgagattagatgaaaatggggactatattactgaaaaaaatatttttgagaagctgattggaaaatgcagtgtatataaagaggaattacgcgcggcatcagcctcttatactgcacaggaatttaatctgttaaatgacttgaataatctgactataaacggaagaaaactggaagaacatgagaaacgcataattatcgataaagtaaaaacaagcaacactataaatatgcggaaaattatcgcagatgttatgggagaaaaaatagaagaattttatggtgcccgaattgacaaaagcgaaaaagaaattttccataaaatggaagtttataataagatgagaaaaactcttgcagaaattcatgtaaatatagaagaattttccagagaaaatttagatgaaatcggatatattctgaccattaacacggacaaagaggctatgatggaggcatttgaacatgcaaacgtgaaattgtcagaagaaataaaagattgcctgatttcacttagaaaaacaaatggagcattatttagtaaatggcattcattctcattgaaaataatgaaggagctgattccggaaatgtatcagcagaccaaagaacaaatgactctgttgacagaaatgggtgttatgagagggcagacggataaattcgaaaaaaataaatatataccggtagatgcggcagatgaagatatttttaatccggttgtccgcagagcggtcagaatttcgtttaaaatactaaatgcgctcatgaaaaaatatggcacattagaggaagtagtaattgaaatgcctcgggatcggaattcagaggaacaaaagaaatgggaaaaagaaaggcaaaagaaaaacgaaaaagagttggcttatattgaaaagaagctggctgcagaatataatatattgctttcaccgactgatttttccaatcagaagcaattggggttaaagttaaaattgtggaatgaacaggacgggaaatgcttatattccggtaaaacgattgagccggaggatttgattaaacattcggagctatttcaaattgatcatattattccaagatcaatttcttttgatgattccagaaacaataaagtgcttgtgtatggtgaggaaaatcagaagaaaggaaatcagacgccatattattatttaatacatgccaataaccaatggtcttttgaacagtataaagctttggtgatgaaattgtcgaagaaaaaagaatatggtatttccaaaaagaaagtacagaatcttttgtatagtgaagatattacaaaagcagaggtgttacgtggatttatcaatcgaaatatcaatgatacaggttatgcggcaagagtagtattgaacactgtacaaggatattttcgtgcaaaagaaattaatacaaaggtaaaagtgatacggggaagctacacttatcagatgcgtgtgaatatgaaactggataagaaccgtgaagaaagttatgcacaccatgccgtggatgctatgctgattgcattttcacaattgggatatgaagcgtatcgaaaattacagggcgaatttattgattttgagacaggcgaaattttaaatgcggaaaaatggaacgctcaaatgtcagatgaaatatatgaacaatatctttatgggaaaaaatggagcaatattcgaacccagattacaaaggcggaaaagcaggtaaagtattggtatcatgtagatcataagtcaaaccgtggactttgcaaccagaccattcgcggaacaagaacatatgaaggaaaaacctataaaataaataagctggatattcggacaaaagagggggctgcactttttaaaaagcttgcatttagtgaaaaagagagcgatagagaaaagctattggtttataaaaatgataaaaaaacatatgagaatctcattcaaatcgctcaggagtattcggattcgaacaatccatttgtgcaatatgaaaaagaaactggagattgtgtgcgaaaatatgccaaaaaccataatggaccgcgtattgacaaattaaaatatacagatggcgaagttggatcatgcattgatatttcacacaaatatgggtatgagaaaggcagccagaaagtggtgcttgagagtctggtgccataccgcatggatgtttattataagaaagaggaacagacttactatttggtcggaataaaacagtcggatgtaaaatgtgacaatggggagtatgttattgacgaagatgcatatgcaataaatctggtgcgggagaaaatgattcaaccaggacaaaagagaggcgatttggaagcgcttggatttgaatttcaattatcattttataaaaatgatattattgagtatgagaaggatggagagatcgtcagggaaagatttttatccaggacaatgcctaaggtgaaaaattatattgagacaaagccgatagacagagcaaaatatgaaaaacaaaaactggtgggacttagtaaaacgaaaatgattagaaagtacagaatggacattttgggaaattattatatgtgcagcagggaaaatttttcaaaatattgttaataatagtcggtattcgcatctgtgttgtggtttatatgacagaaaattaagtaacatagaatatagagcatagaaaaaagacgtttcgaaattctgcttcgaaacgtcttttttatgtgtgcctagcggcgcacgtttctaacgggttaaagtcccgaatccgcccggtagtgggaaggatatagccgaaagcaagggtgtccatcgtgagatggaatctgaaggaagctggatgtgaggaacatactaactcatgggcaaatctctggtctgacggacagaaatctcatataaggttatgcatgagggtaaggttgcatatcaaattgaagcccaatagctacacggaatcatgcatgataaatgagacagatggatggagaggaagaaacgtgtggtacctagggaggtctgtgcggtacgccttgaaagaggtaaccattgcataaagcaatgctgaacgcacagaagtcagcagaggtcatagtagccgagaggtgaaggaccgaatcagtaggagtcttgagtatgaccgagaaaggaggaatgaccgtctatggcagaaaacattgaaaacaatggctgttcgcaaagagataatgcagaacatgaagggtatgtgaaagcgtctaggtcattcaatcggatatggaaagaaagggacagtgcacagccgagacttttggaagcgatactgtataaagacaactttaacagagcgtataagagagttaaggcaaacaagggagcgccgggaattgatggcatgaccattgaggaggctcttccttatctaaaggaacatcaacaagagataaccgaccgcatttatcgtggaaagtatactccgtctccagtaagacgagttgagattcccaaaccagatggtggtgtgcgaaagcttggcataccaacagtggtagaccgtacactccaacaggcaataacccaacagttagtgccaatctatgaaccgctgtttgtagagggtagctatggctatcgtccgaacagaagtgcaaaagatgcaatacttaaggttaaggagtatgccgaacaaggctatacatttgctgtagtccttgatttgtcaaagtacttcgatactattaatcacgaaatcctcattgaccttcttcgcaagaatgttaaggatgagcgtgtagtacagctgataaagcgctatctgaaaagcggtgtaatggaaaacggagtagtcattgatacagaggaaggctcaccacaaggtggaaatctatcaccattgctggcaaatgtctacctcaatgagttcgaccaagaattcttgaaaagaggtgttccatgcataagatatgcagatgacatcgtgcttcttgcaaagagcaggcgagcatcagagagactcttggaaagcagtacaaaatatcttgagaagaggctgaaacttacagtcaaccgagaaaagagtcgtactgtcagtgtgtttgcaatccaaaattttaaattccttggctttgcattgggaaggaacggaaagggcatttatgtccgagttcatccgaagtcatggaagaagttcaagtccagactgaaggaactgtcttcccgtaagcgatgtcagtcaatcaagccaagccttgagaaaatcaaggtgtatgcgaggggatggcttaactactacggaattgcaagtatgaagaagaacatagatgacatcaacggatggctctatcacagaatacgtatgtgtatatggaaacagtggaagaaaccgaggacgaaggtacgtaatcttatcaatatgggagtaccaaaagacttggcaatgcaagcgggtaatacccgacggggacattggttcgcaacgcatacagttgcagtaaacatggcaatgacaaaagaaagactgataaacagtggcttttatgatttagccacagcctatcagtctgtgcacgtcaactattgaaagcgccgtataccgaacggtacgtacggtgctgtgagaggacggcggttagtcaccgcctcctactcgattattcaacacagacatcggtcttctgttggagttcctttttggtacggtgtttccacaccagataggtgacaagcagcagaataccggtggtcagccaggcagcagcatcagcactgcatacacccacgtatccaaaaggctttgtggcgatcaggataaccgcataacggctgaacagttcaagtacaccgctgagcatgggaaccagaccacggtctaagccctgcagaccattacggtatacaaagatccatgccagaggcagcataaaaatacttgcaatgtgcagatactgcattgctgcgtgcagtgtctgttcagatgggttgtggatgaaccatccgaccatcgtaggtccagcaaggcagcagagcagtgcggcggctccggctgcaaagaaacataaataaaatgcatctttcataccgcggaaaatgcggtcatgttttccagcaccgagattctgtccgcagtaggtggccatggctgtaccgagtgtcggcatggtctgggtggcgatgttgctgactttggaagcagcagtaaaagcagctaccacgctggaaccaaacacgttgacggcactttgcaggatcatggttccgattgctgtgatggaatagtttaaagccatcggaattcccacagacagcatccggcggatctcatgaaaatcacagtaataatcttcgcgtgtggtccgcaggatgtcatatttgcggaacatgacaatgaaacataaaactgcggaaaccgcctgcgagataacggtggcataagcggcaccggcagtgccgagttttaccacaacaataaggaagatgtccagaaaaatattgagaccgctggacaggatcaaaaaataaagtggtgtccggctgtcaccgatcccacgtaaaataccggatgctacgttatatgccatggtagcaaagataccggcaaagatgacccggatgtaccggtttgccagtgtgaggatattttccggagtattcagccacagaagcagctggcgggaaaacgcaaccgtaggaacggtcagaatcatggaaattacaaccgttaaaagcagtgaaagtgctacgcaatgacggagaagtttcatgtctttggcaccgaatgcatgggataccatgacaccgaatccctgagcaattccgttggcgaaaccgagaaccagaaacatcaggcagcccgtagaaccaacggcggccagtgcatcctccccaagatactggcctacgatcacggtgtctaccatgttgtagaactgctggaacagatttccaagcagaaccggaagggaaaaaagaagaatgatcttcattggatttccgatcgtcatgtcttttctcatagtaaaatctcctttacatcttattcatttgtaattgtagtcaaagaaagagactaacagtaaggatagtctcttttcgtgcgggcaacaggacttgaacctgcacggtctcccactagaacctaaatctagcgcgtctgccaattccgccatgcccgcaagtttatgtagtttttgtatcttttattatagaagatactttactaactataacgacattgtgtgcagatgtcaattactttttgcttaaaaaaatgacaaaattatgggaaaactacttgacgaatagaaaaaaatattgtatcatatattacgtgttttgcacaagggcttatagctcagccggttagagcgcacgcctgataagcgtgaggtcggtggttcgagtccacttaagcccatatcctacaggatgtccggtatgaccggacatcttttttgttttattgacaagaagacagtattataaataggggttacagttcacagattgccctgcaaaccgtaacaaataaggtacaaagcatacaatacccattttttgtatattgacaaaatattttatgaaggtataatacgaattatcatttgtatgatccattgaggtaaattggtacgcaaataatgtcaaagggggcatgtttacgtgctttttttttggaacactttaacgtgctacagagctaatgaggcaatgagataatacgatgaaattactaaatactcaataagaggtaggagagaagaacatgagtaaatatcttgtaaaacgtgtattgttagcgatattatcaatactcattgtaagtgccattacgtttttcgtaatgaacctgattcctggtggaccgtttaataaggagaaagcgaccagcaaggaagcacagcaggtattggaggaaaggtacaatctggacaagccggttccggaacagtatgtattgtatatgaacaatctgctgcatggcgactggggagtttcacttcacagtggaagaaatatcggaacagagatttccagaaagtttgcagtatctgcaaaattaggtggagttgcggcaattgttgccattatcatcggtgtgatactgggcagtatcgcagcacttacaagaaataaactgccggatcgtctgatcgtatttttcacgacactgggtacggcaatgccgtcttttgtactggcaacgctgcttttacttgtattttgtttaaaactcggatggattccggtatggtcttcgagcaatccgaattatctgctcccaatcattgcactggcggcatatccgatggcatatattacgcgtctgacaaagacaagtatgctggatgcgctaaatcaggattatatccgtactgcaagggcaaagggtgtgcatcggctcaaagttatttttaagcatgcgctgaaaaatgccctgattccggttgtaacatatgttggtcctatggttgcctatattctgacaggttccatggttgtggagaacatatttaccattggtggtcttggaaccgaattcgtaacaagcattgtcaaccgtgattacactatgattatggcaatcacgattttccttgcggttctgatggtagttgcaaatcttcttacagatattgcatataaactgattgatccaagaatcacatttgaataatgatggaggaaggaacttagaataatgcagggaaatgaagaattaaaaaagcggcagatactgtccgcacagattgatttaagtaaatttaataagggcgattttataaaggcaacggaagaagagaagaagcagcaggatgtcatgggcgagtcaacgacattttttaaagatggcatgaaacgtctgaaaaagaatccgctggcaatgggaagtattgtgattctggttctgattctggcactgatcattattgcaccgttttttgtaccatacagctattcggatatcattacagtggacggcaagcgtgacaagaccgcagccaatatggcaccgtttgagtactcgaaattagagcagcagtacatggatcgtaccggtgagaaactgtttccgcatatttttggaaccgataacttaagccgtgattactttatccgtgttatttacggtacgagagtcagcctttcggttggtgtgatcgctgcaatcatggtacttatcattggactggtttatggttcggttgcgggatattttggtggaaaagtggatctgatcatgatgcgtatcgtggatattgtgtattccttgccggatatgctcattatcattctgctttcggttgtgtttcaggaacggttaaagccattgattgagggaaccatgtttgaaaaactcggaaccaatatgatctccatgtttattgtgtttggattgctttactgggtaagtatggcgcgtctgatccgtggacagattcttacaattaaaaataatgaatatgtactggcagcacgctgtatcggtaccagaaacagccgcatcctgacccgtcatattctgccaaactgtttatctgttatcattatcacgaccgcattgcaggtgccgagtgccatctttaccgagagctacttaagtttccttggccttggggtaagtgcaccgctgacttccctgggaagtctggcaaacgatgcgcgttcagcaatgcagtcgtatccgtaccgtctggtaattccggcagtgctgatctgtctgatcgtacttgcgctgaaccttctgggcgatggattgagagatgcatttgattcaaaactgaattaaggagataagcaaatgagtgaagaaaataaatatatattacaggtaaaagatcttcataccagctttgctacggatgctggggaagttcgtgcggtaaatggtgtctcctttaatctggaaccgggaaagacactgggaattgtaggagagtccggttccggtaaatccgttacttcttattcgatcatgcagattcttgcggaaaccggaaaaattaccggaggagaggtactttatcacggcgaggatatttccaagtggaacgaaaagcagatgcagaagttccgaggggaaaagtgctcgatcattttccaggatccgatgacaagcctgaatccggtatttacgattggaaatcagttgatggaggcaattctgctccacacagacaaggataaaaaacaggcgcgtgagcgcgccattgaaatgttaacactggttggtgtcaatgagccggaaagtcgtctgaaacagtatccgcatgagttatccggtggtatgcgccagcgtgtgatgattgccatggcactggtctgtgaaccggatattctgatcgcagacgagccgaccacggcacttgatgtgaccattcaggcacagatccttgaactgatgcaggatctgcagaagaagctcggtatggcgatcatcatggtaacacatgatctgggtgttattgcaagtatgtgtgatgagattattgtcatgtacggtggccgtgtctgtgagcggggcacagcggatgccattttctatcatccggcgcatgagtacaccaaaggactgctccgctccatcccaaaggcagacaatatgaacgaaaaactcatcccaatcggcggaactccgatcaacctgctccagatgccggagggctgtgcgttttgtccgcgttgtgagtcggcaatgaagatctgtttaaaacagcagccggcggagtttcgtgtgggcgaagaccatctggcgagctgctggatgaatgtaaaagaaatttatgaagcacaggagggcggcagcaatgagcagtgaaaagaaaaacaatgattatctgctggaagtagaacatttgaagcagtattttccggtgcatcagggttttagcaccattccgctgaaagcagtggacgatatttcctttgccatccgcccgggagaaacacttggtctggttggcgagtccggttgtggaaagacaacggtagggcggacactgcttcggttgtaccagccaacggcaggtaagattacgtttgacggaaaagttctttttgacagtggagaacagtatgacgaaaacggaaaagtgatcgtggatacgaacgggaaaccggtcatgggcaaaaaagtggatgtcaatatgatgccataccgcaaggaaatgcagatggtatttcaggatccgtattcctcattaaatccccgtatgacggtggaagatattatcggggaacctttggatgtgcataaactctacagaaataaaaaagagcgccgtgaaaagattctcgatctgatggaactggtcggtctgaatgcagagcatgccatgcgttatgcgcatgagttttccggtggacagcgccagcgtatcggaattgcccgtgcacttgcggtaaatccgaaatttatcgtctgtgatgaggcggtatctgcactggatgtttccattcaggcacaggttgtcaatatgtttgaggaattacaggaaaaacttggagttgcctatctgtttatcgcacatgacctgctggttgtacatcatatttccgaccggattgcagttatgtatctgggaaagatgatggaaattgcggatgcagatgagttaaatgcaaatccgatacatccatatacactgagtctgctgtccgcagttccgattccggatccggagacagcaagaaaaagtcatagaatcgtgctggagggggatgttccaagtccgctgaaaatgccaaccggatgtccattccgtacaagatgtaagtatgcaacggaaaaatgcggtcaggagatgccgcagctgaccgacagggggaatggtcatatggttgcatgctggaataaataaggttttttcccgcaagggtgaaacatataaataattttcaggaggaacaattatgaagaagaaacttgtatcaatcatgctggttgctgcaatggctcttagcgtagctgcatgtggttcatcaaaaggaaactctgcaaagacggacggaaccgaagcaatggcttccagtgtaagtaaaacaccggacaaccagataagcattaaccttgcttccgagccacaatccatcgatccggcactgaactctgccgtagatggtggatgtatgatcgtgaattctttcgcgggtctttatacctacgacaaggacggcaagctgattccgcagctggcatctgatatgccggaagtatccgatgatgaaactgtttatacggtaaagatgataaaatcccagtggagcaacggggaagaggtaacagcaaacgacttcgtatacagctggaaccgtgctgcggatgaaaaaacagcagctgattatgcgtatctgtttgatattattgcaagaaatgatgacggctcacttgctgtagaggcaactgatgattatacgttaaaaattacactgaccaatccatgcccgtatttcaatgacctgatggcatttcctacttatttcccggtataccagaaggatgtggaaaaagcggatcctgatggaaagaatccgggtaagtggtgtcaggaggctggctttgtatcaaacggtgcttatacattaaaatcatggaagcacaacgagagcatggtttatgtaaagaacccgaagtattacgatgcagacaatgtaactatggatgagatccacattatgctgagtgcagatgatactgcaacctatgcagcatacaatagtggagaccttgactttgtagataccgttccaaacgatgagatttcaacattaaatggaaagaactctgatttccatatcattccaaaccttggaacttattatgttggttttaacgtaaacgacccgatttttgacggaaagaccgtagagcaggcagcatctatgcgtaaagcaatgaacctgctgattgatcgtgagtttatcgtggagaatgtaggacagaccggacagattgctgcagattcttttgtaccggcaggtatgtcagacggtaacggcggagtattcaagaccgatgatacaagctactatgatgcaaccaagacaggtacagaccaggtagaggaagcaaagaagctgctggaaagtgccggttatacatttacggataacggagatggttcatacaagtgtgatccggcaatttccatgacgttcctgaccaacgatgacagtacgcatattgcagtcggggagtccctgcagcaggatttcgcactgctggggatcaatatggagattaagtcggaagactggaatgtatttattgaagaccgtaagtccggcaactttaccatcgcccgtgagggatggctggcagattacaacgacccgatcaatatgttagaactctttacaacggattctggtaacaatgatatgcagcttggaaagggtgacaagccttccgattctgcaccggactggacggattataacaagctgatcaaagagatccgtacaactgctgatttctccaaacgtgtggatctgatgcatcaggcagaggatatgctgatggataccggtgcagtaatgccgatttactactacaatgatatttatatgttaaagtcaaatatcaagggcatttactctaccatctatggtatgaagtactttatgtatgcaacaaaagacaaataaaatcatccggatacaaccgcgatgagaaacatgaaaagggcgtgtgaaaaaacgaaagttttttcatgcgtccttttgcttatagatacaacagtagttatattttataaaaaagtgtatactccccctttccccataagaatgctattatggaatcctatgcggcagttgcgacttttttctgtttattgtgatatttataaagattgtgtccaatagaaacaagaaatacttcaagcaatacagattttatccctcttcggacaattcttttataccaacggtcgttttttatgataccaaatgtaccttcggcctgaatggatctgttcatccttagaagcgctcccttgatactttcgagattttcaatcacttcctgatgcatcgatgtaagttcatggttgagccgaacggtacggtttttatctgtctttttacattgttctgcatatggacagccggaacaatcttcacactgatatacttcttcctgtcgtccatacttgtttccctttacatttttacgatactgaagataaaagcttttcccgtttggacaacgcatgattccgtcctccccgattgggaaatttactgcacgaaatggatcttcatgatacttcttgtcagtagtttctttcttgaacatggggaacttcatatatttttccattccatgctgctcacagaagatgtaattgttgtaagaaccatatccggcatctgcgactggatactttggatagaaaccatatatattctgaaacttgttcattagtggaataaaacagtccatatcggaacggtactgatttacatcaacaacagcaatgtattcatctgcaacaccaacctgtacattataagctggaagcagctggtcatttcccatgtagtctgtcttgattcgcataaaagtagctgaatgatctgtttttgagtagctattacgatcttctccacagatcctgattttttctacatattcttccagcttggcagtatactccctgagtttctcataatgacgttgctgcgtagttttgcgatgtcccctgccatgaacaaacatcgtttcatcaatctgccagacttctgcatactgttcagcagcttctttcagatactctggcgcatactcgctattgatacaaaactttatacccgtacattccagttccttattgatttcctcaaagagtgtggtgatcttatcaaatagacggtatctggatttttctgttgattttttccatacccaggagtatttattcgcatttgcttcaaacttggagccatcaatgtataggtgttggagatccacgtgttctgtctcgaagatttttttgtttatgtcctgaaatatttcttctatggaatcagcaagtacctcgtttataaagtagccgaaggtacggtaagaaggtgtttgatgatccatgagatacatgaagcggagattgactttacactgatcctccagctcacgtaatgatatatagccatttgccataaatccaaacaaaactgtcttcagcatgctgaccgggtcatatctgagtcttcctgtatcatgttgcggaatatttttcagatatttctccagttcgatttctcccataaatctgtcaaatgtcagcaccggatcacagatgtccagataatcttgaattagtattggcaaaactgcctgttttgggttagaatagattatgttattaattttcattgcaagttaattataacagaaagaaagaccttgagttcattataaactcttggtctttcttttttcgggactattcttttttcacagcccctttttgtgttttgttaatacagattttttttctcgtgtgaccatttttccggatgatcctcatactgtgcgttaatccagtcaacgacctgctgcttgccttcgtttgtaaagggcgcagtaaaatccgttttgagggaatcatccgtcagggaaaagataagaggaccgggccagacccatgcatgaaaaaaggcgtccccttcctcgggggcttcccgtctgatcagaaaacgcatgccgttgatccagccggtatagctcgtttttttgtaataatttaagtttaatacttcgtcagaggttaacatagtatctcccagtttcattattttgtaataattgtaacacatttccattaattttggtataatgtctgttagagtgtttgaacgaaggtgaaaaaatatgtttgggagaaatgattttatagaaaatataaaagatgcactggcagcggccggttgtgatatgggggcatttcgcagctggcagaaacagtatgaccgtctgaagaaaaaacaaaaagaacagaaagagcgttacgagcgctgccgggaacagacgaagcgggtgcaggaagatgcacagctgatggaacagatgcttattgcagaacagactgcggatcggaaggagtttggcagattattaaaagacctccggcagatgcagaacaattttgaccatgaatttctggtgagcaaggaagatcaggagtttcactccacatatgatacgatcctgcgtctgggaatgaaagtattaaatgcttcggatcagaaacttctgctgcagagtgagatcgaaaatctgcttgcacttttaaaggagaatctggaaaaagaggaaccaaagatagaagcccttacgttttattatcagttgggatcggatcaggaactagcacagctgccaccggcagaaaaactggaaaaaattacatatttctatgaacatgagtttcggcagccgattttgcagcttttggaaaacgggatttcccgtgccggacagttaaaagatacttatgaagcagcaactgaccgggccagcaggaaaaaatatgaaatgctgcaggttttgtttgacgggcagccggaacatattttagaacagttaatggaagaataaagacacaggtgaggaggatatccatggaacgcagaccgatgccgggagaaaaataccgacactttaaaaataaattgtatcaggtgattactgttgcaaaacattccgagacaggagaagaattagtgatctatcaggcattgtatggagatttcggggtgtatgccagaccactttccatgtttgtaagtgaggtggatcatgtgaagtatccgcaggtgagccagaaatatcgttttgagcgtgtggatgaaccgatgccggaagcaaagcaggagccgcctgttatggagccgcctgttacgcagcagacaaagacgatagaaaataccatagagccggacatgacacaagcggaagtggaaccaaagcttatggagtttcttgaagcggacagttttgatcaaaaatataatattctgacttccatgagggatgtcatcacagatagcatgattgatacgatggcggttgtgatggataccgtgattccggagggagatttggataagagatatgacgatttaaggtatgtgatccggaccagacaacagtatgaatttgccaaccggctgcgctgattagcgcagtccgtgctgacttaaataactgttatggtattttccggaattggtcacgtcttctccgaaccagtccggtgcggtgaagcgatcggcttcttctatggagtcaaattccacttctacgagagaaagcggagcgagatctttttcaaagatatccagttctgcagtcagatgatcgtttaatggaatcagatagcgggtttttgctatcagaagtccgtcgatttttaaaagcaggtgttcgtaggcttctttggtgagcggtagattgtattcttcccgcaccataaggccttcccctttataggtgagataataatcatcgttggagcggcggatacgtaccaccggtgccgtacacaggtatccctgtgcgatttttttactttgatattgttctaagtgctcaggtaatgtttttaccagatattttcgttcgatttccattttatagaattcctcatttaaaataagttaatagtttttgtacagcgatactttgtggttttccactgtcttctacgagtgtgatctgacgttccgggatttcttcttctaacagaatctcatacacttccccgcgttctacagcgggtctggcaattccttccgggcagaaaccgatgccgagattactgcgcaccataggaagaatctggtctgtcgtggcaacttccatatccggagaaaaacgcatatggttttcatagaaaaagcggatatacagatcacttgttccagtgccggaaatcagagaaacaaaggaataatcttcgagttctttcagagaacgcttccggctggcgattgctttgtaagcactgcctccgatgaggatatcatgatagctgcgcagtgcggttttacgcaaaggttttcggatttctaaaggagaagtgaccatggcgatatcaaccagacctttttctaaggcatcgatggcctgtggggtggaatgattggaaattttcaggcgcacatgtggataatctttatgaaattcctgcagtttgtctaaaaggtacagacgcatggcggtttcgctgatgccgatattgatctgcccgctttcgaggctcttgtttttgataatttctttttctccataggtgagctgttcaattgcaatggcaacgtggcggaacaggtgctcgccctcggttgtcagctgaatccctttgtgagaacggatcagcagtttgcagtcaagctcattttccagaatattcatacagcgggtgatgttgggctggttacttccgagcatttctgccgcgttggaaaagcttttataacgggcaacataatagaaaatgcggtaataatctaaagtcatgatattccctcctcataaactatcgaaagtataatacaaaaatggcaggtgagtcaaatggaaatcctccgattgtgtgcttgtcgtttttgtaagaaattgctacaatagatcatagcaattaccgaaaaggagaatgataaatatgagcagacttggaatttttattgcagacggatgtgaagaagtagaagcactgacggttgtggatattgtccgccgtgcaaaacttgaaattgacatgatttccatcaacggaacaaagcaggtgaccagttcccgcaatgtgacatttatgacagacacgacaaaagaggaggctgacttttccgcttatgacgggatcattctgccgggcggtatgccgggaacggttcatctgggagaagatgatacggtcagtcaggtgatccgtgagtttgcaaaagaaggaaaacttgttgcggcaatctgcgcagcaccgagtgtgctgggacaggccggaattttaaatgggaagaaagctgcgtgtcatccgggatttgaagaaaaactgaccggagcagaagtattcttttccccggtagtatgtgatggaaatgtgattacaagccgcggcatgggaactgccgtaccgtttggtcttgcagttgcccgttattttaccgatgatgcaaccatagaacatgtaaaagccggacttgtatacgcataaacaggttccagaaattgtcagctttttgttctcataattcctctggttctggtcacactatactcaggcacatgagaacagcaagttgaccccaaaagccgacctgccttcttgtgtgcaggccggctttttttatgcaggcatataaaatacaggaggtgaagaactatggcaggtaacaacaattcatcaagcggtacaaaccgtatggcagtaccggaggcaaaggacgcaatgaagcgttttaaggaagaggttgcaagcgagcttggagtacctttaaaagatggatacaatggggatctgacttccaaacaggcaggttctattggtggagaaatggtcaagaagatgatcatgaagcaggaagaacagatgaaataaggactttctgccggaaaacaaaacagcgtatggctttttacaggccatacgctgtttttgttataggaaataaaaaaacacttggcaaatatgtatttcgtatgctataatgcttaaatgactgtggtggtcgtagtatgcctgtttgtaccatcacggaaaaatagatcgtacatggaattgatatatataaggaggaaacaattaagatgagtgtacaggttgaaaatttagagaagaatatggcgaaacttaccatcgaggtttcagcagaggatctggagaaagcacttgagtcagcttaccagaagcagaagaagcagatcagtgttccgggattccgtaaaggaaaagttccgagagccatgatcgagaagatgtatggagttgacgtattctatgaggatgcagcaaacgctctgatgcagcagaattatgcagcagctgttgacgaaagcggaattgatattgtgtcacgtccgaccgttgacgttgtacagattgaaaagggcaagccttttattttcacagctgaagttgctgtaaagcctgaagttacacttggcaaatacatgggagtgaccgttacaaagatcgatacttctgtatccgatgaagaagtagacgaagctctggaaaaagaacgcaataacaatgcaagaaccatcaatgtaacagacagaccggttgcacagggagataccgctgtgatcgattttgaaggatttgtagacggcgttgcatttgagggcggtaagggagaaaaccatgcattagagatcggttcccacacctttattgatacatttgaggatcagctggttggaaagaatgttggcgatgaagtagatgtaaatgttactttcccggagcagtatcaggctgctgatctggcaggaaagccggctacattcaaggttaagatcaacgagatcaaagcaaaggaacttccggagcttgatgatgagttcgcaaaggatgtatctgagtttgatacattagctgagtacaaggaaagcttaaagaaagacttggagaagaagaaacaggatgaagcaaagcgtacaaaagaagacgaagccatccagaagatcattgacaagtcaaagatggagattccggaggcaatgatcgatacacagtgtgagacaatgatcgaggaattcgctcagagaatcgcacagagcggtctttccatggatcagtacttacagttctccggtcttaccgtagacggattaaaggagcaggttcgtccggaagctcttacccgtatccagagcagtctcgtattagagcagatcgctaaggaagaaaatatcgaagtatctgatgcagatgtagatgcagagatcgagaagatggcaaagaattacggtatggaagctgataagctcaaagagtacatgggcgaaggtgagaaagaatccatgaagagagaacttgccatcacaaaggcagttgaactgatcatggacaacatcaaagaaagagcaaaggctaagacaaagaaagaaaaagaagctgaggcagaagcagaggcttaatattgaaaactacgacagagaaggactggtctgggagaataccagaccggtcttttgttcattgaggtgcatcgcaggatgcatgtaataaatacaggaggcgatttttctatgagtttagtaccttatgtcattgaacagaccagcaggggcgagagaaattatgatatttattcccgtctgttaaaagacagaattatctttttaggggaagaagtaaatgagacaaccgcaagtcttgttgttgcacagcttctgtttctggaatcggaagatccgaacaaggatattcagttatatatcaattctccgggtggaatggttactgccggtatggcaatttatgacaccatgcagtatatcaaatgtgatgtatcaaccatctgtatcggactggcagccagcatgggtgcgtttcttctggctggtggtacaaagggaaaacgttttgcactccctaattcagaaatcatgattcatcagccttccggtggtgcaaaaggacaggcaacagagattcagattgcggcagagaatattttaaagacaaagaaacgtttgaatgaaattcttgctgcaaacaccggtaagccatatgagacaattgcagcagatacggaacgtgacaattatatgtccgcgcaggaagctgcagattacggcttgatcgatggagtgatcacgaatagatagttatgtggaaacctccggtcattgccggaggtatttttcatttataggagtaaataaattatggcaggaaagaatgatggcaaaatccgctgctctttttgcggaaaaacacaggatcaggtcggaagaatgatttcaggtccaaatggtgcatttatctgtgatgagtgtgtagatatctgcgcagagatcatcgaggaagagaatctggaagaaaaagctccggcttctgcaaaggaagaaatcaatctgattaaaccggaagaaatgaaagcgtttctggacgattatgtaatcgggcaggatcaggcaaaaaaggtactttcggttgcggtatacaatcattataagagagtgcttgcagatcaggaaaatgatgtggaacttcagaaaagcaatattctgatgctgggaccgaccggttccggaaagacgcttctggcgcagacacttgcccgtgtacttaatgtaccgtttgcaattgcagatgccacgacactgacagaggccggttatgtgggagaggatgtagagaacattcttttgaagctgattcaggctgcagattatgatgtggagcgtgcacagcacggcattatctatattgacgagatcgataagatcacaaagaaatcggagaatgtatccatcacgagagacgtatccggagagggtgttcagcaggcattacttaagattctggaaggaacggttgcatcggttccgccacagggaggacgtaaacatccgcagcaggaactgattccgattgatacaacaaatattctgtttatttgcggcggagcatttgatggtctggagaaaattgtagaggcacgtatggacgcttctgcgatcggatttaatgcagaggtgaagtcaaagtctgacatcaatgtgggggatgcatttaagcgtgcactgccacaggattttgtgaagtttggactgattccggagtttatcggacgtgtgccgattactgtatctttagattcgctggatcgcgacgcattgatccgtattttaaaagagccaaagaattctctgatcaaacagtataccagacttctggaactggatggggtaggactggaatttgaggacagcgcaatcgaagcaattgcagataaggcattagagcgcaaaaccggagcgcgtggactgcgtgccatcatggaagcggtaatgctggatctgatgtatcgtgtcccatcggatgattccatcagcaagtgtgtggtagataaaaagatggtggaaaacaatcttgctttagatggagaagagattcttggaattgagcagaacccgaagaaagaagtaaaagaagaacttgcttcataaaaagaccggatgcgtctggaaatataggagcagatacaagtggaagataaaatattgacaattccggcagtggcactgcggggaatgacgattttgccgggcatggtggctcattttgatatcagcagggacaaatccctgcgtgctgtcgaggaagccatgaaaggagaccagaagctttttatcgtcacacaaaaagatacagagaaagaagatcctcagggagaagatctgtatgaagtggggcttctggctgtggttcgtcaggtcgtaaaattacagaaaaatattatgcgtgtactgatcgaaggaatcgggcgcgcagagatatatgaatatacacagacagccgattatatgcaagcgcgtgtgatcgtgtatgatcaggaagacgatgaacagcttccggagcaggcaaagtctgcaatgcttttgagtgtgcaggaaacgtttgcaaaatatgcaagagtacatggcaaaatcgggcaggatgtgatgcgccaggttcaggaagagacggatcttttaaaacttcttgattatgtgggaaacagccttgtaatcagttataaaaagaaacagaaactgttagaggctgtcacgctgacagcacgttatgaggcggtgctttcttctttgctgcaggagacagagattctggctttaaagcgtgatttccagaaaaaagtgcaggaacatgtggataaaaaccagaaagattacctgcttcgggagcagatgcaggtaatccgggaagagctgggagaatccaatacagaaaccgatgcacaggagtatgaaaagaaactgcaggaacttcaggcttccggggaagtgaaagcaagaattcataaggagattgagcgttttcagggaatttcaggaaattcatccgagagtacggtaagccgtggttatatcgaaaccttactggaacttccgtgggatgcagtatcggaggataacaaagacttaaagcatgcgcagaagattctggatgaggatcattacggtctcgaaaaggtaaaggaacgtattctggaatttcttgcagtccgtaatctgaccggaaagggagagagcccgattatttgtctggtggggcctccgggaaccggaaaaaccagcattgcgcgttcgattgcccgtgcgctggataaaaaatatgttcgtatttcactcggaggtgtgcgggatgaagcggagatccgcggacaccgcagaacctatgtgggagcaatgccgggaagaatcgtcaatggactgcggatggcgggagtcaaaaatccactgatgctgctggatgaaattgacaagatgagcagcgattataagggagatacagcttctgccatgctggaagtgcttgactcggaacagaatcataaattccgggatcactatgtagagcttccggtggatctgtccgaggtactgtttattgcaagtgccaattccatgcaggatattccgggaccgcttctggatcgtatggaaattatagaagtcagcagttatacggaaaacgaaaagttccatattgcaaaggatcatctgctggcgaaacagtttgaaaaaaacggagttgcagatggcaaactaaagattacggacaaagcgctgcgaatggtgatttcttcttataccagagaagcaggtgtacgttctctcgaacggcagatcggagaaatctgccgcaaagcagcccgcagaatctacgagggcgatgagaaaatgattcgtgtaaccggcacaaatctggaagattttctcggaaaactgaaatatcgtccggagaagaaaaacaaaaagaatgaagtaggcattgtgcgcggtctggcatggaccagtgtgggtggtgtaactttagagattgaggtgaatctgatgccgggcaagggcagtgtggtgttgacgggaaaactcggagacgtcatgaaagagtctgcacagaccggaatcagttatattcggtccatcagtgaagattaccatattgatccggaatttttccagaaacatgacatccatatccatgttccggaaggtgcggttccaaaagacggaccgtctgccggaattaccatggcaaccgcaattctttctgcggtcaccgggaagccggtacgggcagatgttgccatgacaggggaaattacactgcgcggacgtgtacttccgattggcggattaaaagagaaattgcttgcggcaaagaatgccggaatgaagacggtttgtattccaaaagagaatgaacaggatcttgccgaaatttcggaagagatcgttggagatatggagatcataccggtagaacatatggatcaggtaattaaggctgcatttgtataatgcagcccaaattctttttgcaggagaataaatatgattatcaaaaatgtgaatttggagacagtttgtggaattacaagtgcgattccggacaacctattggatgaagtggcttttgccggaaaatccaatgtgggaaagtcatcgctgatcaatgcgctgatgaaccggaaatcgcttgcgcgtacttcttcccagccgggaaaaacgcagaccataaatttttacaatgtcaatgaggcaatgtatctggtggacttgccgggatacggatacgcaaatgcaaatattgagattaaggcgaaatggggacagatgatcgaaaattatctgcatacatccaaacggctgaaagcagtttttcttctgattgatatccgtcatgaaccgtcggaaaatgatcagatgatgtatgagtggatggttcatcagggatttgcgccaatcatcattgcaacaaaatcggacaaattaaaaaagatgcaaatcctgcaacatgtgcaaatgataaaggatatcctgcaagtagagccgggaacgatcgttattccgttttctgcggagtcaaaacagggccgggaagaaatctggcagattgtagaatccgttattgaacttccgcaagggtacatcgaggcggaaaatgccaaaagagaggcaaaacaaaagcagccggcaccgcaggaaccgaagaaaaaagaacgctggaaaaagacagaccgcccggtagccaaaaagacacttcgaaaagaacagaaaaagaaagtgaaaaaaaagtagaatgaagaaaaagtatttgtatactgcaatcatgctttttgccattctggtggcaggaatgggactgaccggatggtacgtcagccagacacaggaacagacggatggacaggaactgacggttgtgacttccttttatccaatgtatattgcggctgagaatgtaatcggggatgcagacggagtgcgtctggaaaatttaagtgagccgcagaccggctgcctgcatgatttccagctgacaccggaagatatgaagttactcagtacggcggatgtgtttatcatcaatggtggtggaattgaaagctttatgaaggaagttgcagaggcttacccgaatctgaaaattatagaagcttgtgagaatatttctttgctctccggggaggaggacgatacacatcatcatgagggggaaacagaagaagaacatgcccatggggatgtcaatgcccacgcatggatgagcgtttctgcttatgagacacaggtacagacgattgccgatggattatctggagcagatccggaaagaagcagtgcctatcagaatggggcaaaggcatatctggaaaaactggacggactgaaaaaacgtcaggagaaattaaaacaggaaatttccggtcagtcggtgattctgtttcatgaagcatatgcctatgtcgctgtggactatggactgcaggtaaactatctgctggatctcgatgaggaacggcaggtcagcgcaggagaagtatcggatgtgctttctgctgtccgcaaggggcatgtaaaatacattcttgcagaagaactgtatggaaagagtatgggagatacgatccggaaagagtccgatgcaaaggtattatatctggacccgctgaatcgcggaacttacgaaaaagacagttatattaacggtatgaaaaaaaacatggagatacttgaggaggcattttatgcgaaagatcattagtccgtgtggatttcactgcatcaaggtgaatcatctgggggtgtggttcagtgagcaggaaatcttaaaagatgtgaatcttcatatgcactgtggatcgctgaatgcgattatcggaaaaaacggtgccggaaaatcgacattgatccgtgccatgctgggggacatcccgcatacgggagatattgagtttcgggataccaaagacggacggatgcagaatttaaaaatcggatatgtcccgcaatcgattaacatcgaaaaaaatacaccggtcagtgtctatgacctgctggcaagctatgagtcgagatatccggtgtttctgccgaaaaaacggaaattatatgaaaagatcaaaaaacatctgcgcatttttgaggcagaagaactgatcgacaaacaggtttgtaatctgtccggaggacagctgcagagagtgcttcttgcactggcggtgatggatgagccgaatctgctgcttttggatgagccggtatccggaattgaccagaatggcatggaacttttttttaaaacgatggattatctgaaaaaacattatgaccttgcgattattctgatctcacatgatctggattacgtggcaagatatgcggatcatgtagtgcttctggacaagacggtcctcaggcagggaacggtaaaagaagtatacgaaagttccgaatttgaacggattttttctgcgggaaaagaagagacatggataaaggaggatgagacaaatgattgattggacctcctggatggattatggttttatgaagatggcattggccgcaatactgatcattacaccactgtttgggctgatgggaaccatgattgtcaataaaaaaatggcatatttttcggatgccctggggcattccgcactgacgggaattgctgtaggagtggtatgcggaattccggatacgaatatttccatggtgatttttgcagttgtattcgcgctgctgttaaacaaaatcggaagcagaagtaccgtatcaaccgatacgattatttcggttttttcctcctgttcggttgcgattggtctggcaattctgtcaaaaggcggaaatttcagtaaatattcaagtcttttagtcggggatgttctgagcattacaaaaaaggaaatcgggtatcttgttattatttttatcgttacgattttgttctggatcacctgttttaactggctgaatgccatctgtattcaccgggcactggcaaagagcaagcggattccggtacaactgatggattatgtttttgcggtacttgtagcactgattgtcatgctttccatcaagtgggtaggtattctgatcatcaatgcattgctgatccttccggcggcatcgagcagaaatctgtcggtaaatatgcgggaataccatgtcttttcgataattttttccgttttctctggcgtcatggggctgattctgtcttattatacaaacgttgcaaccggcccaatgattgtaattatcgcatctgtgatctattttgtgacttattttttcggaagaaagtggaaagaataacagggagaatagaatttgaccgattgtattttttgtagtacaatcggtgtatacaaaatactgaggaaatacaaatggatgaaataacactcaaagcacttgcaaaaataaatctgggactggatgtggttcggcgcagggaagatggatatcatgaagtgcgcatgatcatgcagaccattcatctgtacgatcttctggagattcaaaaaatccgggagccggagatacagattgtttccaacctctcttttttgccggtaaatgaaaataatctggtctataaagcggcacggctgttacaggaagagtttgcgcttacagatggaatttccgtaaaactgacaaagagaattccggtagcggcggggatggcaggaggaagcacggatgctgccgccatgctgtatgcgatgaatcagttgtatgatctgggattgtcccgcagggaactgatgaagagaggggtacagatcggggcagatgttccttactgtcttatgcgtggaacggcactggcagaaggaatcggggaaaaactgacacagcttccgccgatgatcaaatgtccggtgctgattgcaaaaccatccatttctgtatcgaccaaatttgtatatcagaacctgaagctggatgaacagacgaaccatccggatattgatgcactgatgaaagatatccgggagaaagattttgacggtgtctgtgcacatatgggaaatgtactggaatcggttacgataccaaactatccggtaattgcagagatcaaacagcagatgatgcgttcgggtgcaaaagcttccatgatgagcggaagcggtcctaccgtattcggtctttttgaagatggagaaacggcaaagcgtgcgctgcgggaaatgaaacgctccggtcttgcaaaacaggtatatctgaccacgatctacaacaacaggagaaagtaataattcacacaaacagaaatggagacgataacatgacagatgatctgacgctcaatatggacgcatatctgccactgagagatgttgtatttaatacgttaagagaggcaattttaaaaggagatctcaaaccgggagagcggcttatggagttacagctggcagcaaagcttggggtgagccgtacaccgatccgtgaagccatccgtatgctcgagcaggagggacttgctgtaaccatgccgcgcaaaggggcagaggttgcaaagatgacactcaaagatatggaagatgttctggaaatccgggaggcgctggatgaacttgccgtaaagattgcatgtgataagatttcggagaaagagctgcaaaaacttttagaagtcaaagatcagtttgaaaacagtacaaagaccggagatgtgaaaatgattgccgagatggatgtaaaattccacgatgttatttttgaatcaacgggaaatccgaaactcgtgacgttattgaacaatctgcgggagcagatctaccgataccgtgtggaatatatcaaaaatccggacaattatccggtattgattgcagaacataatgcgattgcggagggactgaaaaacagggataaagaagcggcaacgcttgccatgcacaagcatgtaaaaaaccaggcagtggcggtaaagagcgtgatccagtgtcaggatgaagcagaaaatgaatagtttatgtaacagatggaaatagtaaggacagataccttttggtgtctgtctttttttaggtatacaggcaccttatgggatgaaaagagataggaatgtaaaaatggagcatacaaaaatttcgaccgatattgagcagaatataaaacagttccagcagctgttcgcagacagtgcagatattaaaatgaaggaaatgcgtctgggaaaaggaaaaagaagacgctgttttctggcatatattgaggtggcagtcagcaatatgctgctggaaacgacggctttggggagactgctggcggcattatcggagctgccggacagagacttaaatcgggtactcaatgagaatgcgatggggatttcagatgtgacaccgtacgataccatagaggatgcagcacaggggatgctcacgggggatgcaatcctttttgtggatggatacggacatgcattaaagattgccgacaaaggatatcccggcatgggggtgcaggaaccggattcggaaaaagtaatccgcggttcgaaggagggatttacagattccatcaaaaccaacacggctcttatccgtaagcgtgtgcgatcaacacgggttaaagtagaagaagtacaggagggggtgcgttcgcacacagcaattgacctggtgtacatggcagatctgaaatatgaatccgtgctgcgtcagatccgggaaaaaattacagaatatgagattgacggggtcatggacagcggaatcttagagcagctggcggaaaagaaatggtattcaccgtttccacagtttcagacgacacagcgaccggaccgggcagcacttgcggtgctggagggaagaatcgtattgttatgcgacaattctccggtcgctctcattctgccgacagatctgaactcctttctgaagacgagtgatgactattataatcgctttggtgtggcaacgtttgcacggattttgcgttacatggcagccttttttgccatgacgcttcccggactgtatctggcggtgacaaattttcacacacagattctgccgacaccgcttttgttatccttctgggaggcacggatcggtgtgccttttccggcggcactggaggtcattctcatggagatttcttttgaactgttgcgggaggcgggggtccggctgccgggggcaatgggaaatacgatcggaattgtcggaggtctgattatcgggcaggcagctgtggatgccaaccttgtcagtccgattgtggtgatcgtggttgcgtttaccgcgctttgttccttttccattccgaatgaagaatttgctttttcattccggatattgaaattttatgtgattgtcctgtccgcatggcttggatttttcggatttttgattgcactgcttacggtgttcatccatctgtcgcggctggaaagctttgggattccgtatctcatgccgtttgtgggggcagatgtcaatgattatcatgatgaacgcgacagtatctggcgtgcaccactgaaaaaaatggtgcgaagacccatttatgcaaaacgtggggagcggatacgtctgcggaaaaaataggctgagtaaacagtaacggaggaacgatatgttttcaaataataaccggatatcaacgcggcaggtgttccggctgtttgtgttcgattttgtaggggaaagtacgctgattctgccctcacagctggcggcatttgcgggaaatgacggtctggcatccattgtgctgggcggcattatgggaagcctgtatctgtggtatcttgcatatgttttaaaaaagatggaaacggatctggtcacttatatggaacggattctgccggcatggatgaaaaaaatttctctggtgttactgctggtctattttaccggtatggcaggatacggggcatatatcttttcggacgtgatacaaaaggggctgattgcaggggagtcgtttcccctgattctgattctggtattgctgacggcaggatatgccgtgtgtggcgggattgaaagccgtgcacgggtgtatgagattttgtttgtcgttttgtttgtacttcttgcagtaatgcttttgattgcggcgggggatctggagatggaatatctgtatggcttttttcaggcagataccgggtcggtgatgaaaggaagtctggcagtctttttttgtctgatgccattgtttctgcttgcattttttccctcctatgtgcagaaagaaaaatgggggaagctggtgcatgccgtgcatgcggcaatgtggtttgccataggtgttcttgcggttttgtatgtgatcctgctgggcagttttggaagccgttccctgacgaccatgaaatatccggcaattacgctgatgagcagtatccatctgaggggaagttttttgaagcggctggatgcctttatgatcgccatctggttttttacgctgtttgcacttgtgactgtgtttttgttttatgcacaggaactggtacagaaactgcggaaaaaagatacgcataaaaaatggtatctctgtggggtgatggctgccgttttcggggtggcagaaatgctccaccaaagcagccatggggaatggttccgggattatctgttgtatatcggaatcccgttgtttttgttcctgccattgtttgtacttttgtggggaaaggggaaaaaacggcatgaagggtaaaataaaaaaatatgttgcactggtattgtctgtgcagcagctgctttgcggatgcagtgccacagaactcgaagaccgctgttttccaatgatggcggttgtggacgaaaaggatggacagatttcttttggttatggatttcccaagctgagccagaaggataatacggatctggaagaggcgcgtgtgaatatcgcgcctgtcacgggaaagacgatggaaagctgtgtgcagacctatgatagccggctggaaaaactggcagactgcaatcatatgaaagtgcttgtcttcggggaaaatctgatggaggataccggacggtatgcggatgttctttcttatctgaaacaaaccggacttttcccaagaaacatctatgtatgtgtggcggaagatccattggcattgtttgagacagaagaagatctgccacaggatctgggaagttatctggaacagtatctgcagaatcaggaatcagcgggatcaggaaaactgtttaagcttggcaggctgctggacgagaaggaaaaccatatcctgcagattatgctgccatatctggaaacagaagaccatatcatcttctggaaaaccatgtaccgcgtaccggatgacaggtttttgtataaacaggaaaaataatggaaatgctcttactatcagaggaaagagagtgtgggaaaatgaaaaagaaaaaaagcatgtttatcattttatgtatgttaacggttcttgctgcgggaactgcgcacgcaacagaaaaggaaagggtggacccactgcagccggcaattgcagaaaaaatactgcggtttcatgtactggcaaacagtgatgccaaggacgaccagaatgtgaaactaaaggtccgggatgcggtggggcatatgcttgggcaaaaactaaaaaaggtaacagaccgggcgcaaaccgaaaaaattgtgcaggaccacatggacgaaattatagaaacagcggaaaaaacgctgcacaaaaacggctatacatacggtgccagcgcaaggcttgccaatgtggatttccctgtgaaaacgtatggggattatacgtttcctgcaggcaaataccgtgcattgcagattacactgggaaaaggagaaggacataactggtggtgtgtgctgtatccgaatatgtgttttcagggatcggtatatgaggttatggatgaatcttccggtgaggagctgcgtgaagttttgacacaggaagaatatgcagatgtgtttgattctggaaaaatgcagatccggtggaaattccttgattatttccgttaaactggttatgataatgaagcacgccaatgtgcgttaagatatcaaggaaaagaaggaactggctatgacaaaagacgtattattgtccatcaagggattgcagatcggggaaaacgaacagaatgacacgatagaagtgatctccccgggagattattattttcggaatggcaagcatttttttatgtacgaggaggtcatggaaggtcagaaagaatcgaccaggaacatgattaaagtgcgtgataattatatggaactgacgaaaaagggtgctgtcaacgttcatatgatttttgaaaaaaataaaaaaaatattacatattataataccccatacggcagcctgctggtgggaattgatgcctaccgtgtggatgtgcaggagaaagaggaagagattacggttgaggtggaatatgcgctggagataaacaatgagcatctggcggactgccatatccggattctggcaaatccgaaacaggacccggcattcaaacttgtcagataaacagacgtaagtaatgaatatgcacgaaaacaaacgaaaatgaacgaaaaaattgttaaatattgtgaaaaaatgctgagttgtggtataatgtaaaaaatgataacagagggggaaatcattatgaatacggaacacaggcagcagaaaatttctttctggcattctatgaaaacgcagtttattgcggtagtgattcttgtggcggcagtgattgtaatattgtatacactcatgattatgcctggggtaaaaagcaatatccgcagtatctattccgactatctgctggatctttccatttcgtatggaagggagatggaaagtgccatgcaggtaaatattgatcttttagataatccggaagctgcacaggacattttacagcagctagatatcgcaggagccaagacagcttatgcctatctggtcggatttgacggaacgatgctgtatcatcctaccgctgagaaaatcgggcagccggtagaaaacgatgctgtcaaaaagatgctcaaagagatacaggggggaagtatcccaaaaccggagactgtgcagtatgtatttcagggggagaaaaaatttgccgcatgttataccagcaaaaaacagtttatccttgtagtcacggcggatgatgcagatcttcttgcaccggcattaatgctggagcaaaggggaatcctgatttcaggtgtgctgctgttgctcggggctttggcagcgtttgtttttgcaacacggattacacgtccgttatcaaagattacagattccgtgaaccggattgcacagctggatctgcgaaacgatcaggtactggaacaatgtgccgcacatcgtggggaagtcggaagcattgcaaatgccgtgcttcggatgaaagaggctctgacggaaattgtacagaagatacggcagcagagtggacagttgtttgatgcgtcggaaacgttaaacaataacgcggtaaagacagcaggaaacgtaaataatgtggagaccgcagtaaatgagatcgcaaccagtgcaaccagtcaggcacaggagacacagggggcaaccgagtccattatttccatgggtacgatgattgaggattctacaagccaggtaaaatccatgaacgagacggcagatgtgatgaatgagtccggacagatagccaaaaaggcactggaagaactgggagaaatcaatgagagggcaaccgagtccatcaatgtgatttatgaacagaccaatacaacgaatgattctgccttgaagatcaaggatgcaacatcgctgattgcttccattgcagatgaaaccaatctgctgtcactcaatgcttccattgaggctgccagggcaggagaggcaggaaaaggttttgcggtggtggcagcacagatccagaagctggcagaacagtccaacgaatctgccaagcggattgaggatattatccgtgaactgctgaaagattccgaaactgcagtacatacgatggaagatgtgaagaaaatcatgcaggagcagaacgaaaaagtgaaaaagacggcagaagtttttgaacaaatgcatgaaggtgtcaatttgtccatccatggaatggtatccatagaagaacagacacaaaagattgaggatgcaagaaataagatcgtagatacggtacagagtctgtcggcaatcgcagaggaaaatgcggcaagcacacaggagacctcagcttccatgatggaaattggttcggttatcaatgatatcagtcagaatgcagagaaccttaaaaatattgcagaggttctggaaagaaatatgcagctgtttcagatggaagaatcatgatttgtggaacaacggtatagaatctgcatgaaaagaaaaggcttatcttcccggtggggaagataagccttttcctgttttttcctgtaaacacattatttctttttgctgctggaaccggatttggattctttcaacttggcattggcttcattgtacttttcctgaagctttgcacggaatccttttttctttttgaccggtttttccagcggtccacggagtccgcgtacgcctgtgatataaagaccactgacggttgccttgacttctttcttgaccggaatctcatcgtagatctgctcgtctgcgatcagtgtcatgactcttggtccgactttggcttttacgattggaagtttggcgcgctgcatgagtttgtttgcctgttccattacctgtgaaggaaggccggcatctttcattttcattcgttttttgtcgatgatcagcatcgtcactgtctgcgcagcggctttcatctgctcatcctgttcttcttttttcttctgtgctttctttccgagaaagtacaggacaatcatagcggctaccagaataatggcaatcactaataatacgattcctattggtttcatcgtggatttcctcctctatatactaaaatttattgtagcaaagatttctgtaaaaatcaacgtttactgtttgtattttctatggatttatggtatgtttaattagttgtaaaaggaaagaaagaaggatttgggacattatgaagaaaagagtggttatactttttttgtgcatgacgatggtattatccatgggggcatgtggtacagacagtgataaaaaagcaagtacccagcagggaacacaggagacggcaagtgaagtgtttgacggaccgcacagcgcacagatgaagctggatctgtcaaaacttgtgacgaaacttgcagattataaagggattgatgttacaatctccggaaattatgatgtgacagatgatcaggtggagcagaatctgatgtcactgctttcatattacggaatcaccggagttgaggtaaaagaccgtgatacggttcaaaagaatgattatgtcaaggtggattataccggatatctcgacggggatgcatttgatggcggttctgcgacagacacaatgattgatgtggcgaacaactgtgatgccacacagaagacaaattacattgatggattcagtgatgggcttgtcggcgcaaaagtcggggaagaagtaagttcggatgtgacattcccggagaattaccagtcttcggatctggcgggaaagaaaacaacgtttaaattcaaaatcaagggaatttataagccggttaccatggacacgctgaccgatgacatggtagcagatgcatttaccgagcagaagatcaccacgaaaaaggatctggttgcatatgtacggcaggtactcgaaaagcaggccgcaaattccaagtctcaggcaagtatcagcgcagttgaagatgatctgctggataaatgtaaagtgacaattccggatgagtatctggatgcgcgtctgcaggaatatcagcatgaatttgaagcagacaactgcaatgatacacagactctggaacagtatgccaagaataacaatactaccgtggatgatatgaaaaaacagtggaaagaactgatgatcaagcagatcaaaattgaatttatctttggacggattgcggaaaaagaaaatattacaatcagtgatgatgattttaagtcatttgtagattatctggtaagttcaggcaacagccagatggcagatgaaaatgcggtatataaatattatggtggtggaaataaagaggatggaaagaaaacacttcgtcagctgtatgtggtcaatcaggcgatttcgtatgttgtggagaaagccaatattaccgtagaaccggatacacagacgacagagtcatcggaaaactaaagggttcaataaaaacaactaagggatagattagatttttaacggagggacagtatggaattagtaaatgtcagagagattttcaaaaatacgatcagatatgaaaatcagcaggtaacaatcggcggatgggtaagaagtaaccgtaattccaaaaattttggattcattgtagtgaatgacggtaccttttttgagccgattcaggttgtatatggagatggtctggagaattatgaggaggtctgcaagattaatgtcggagcagcagtcattgtaaaaggacagctggtgcctacgccggaagcaaaacagccgtttgagatccaggcagcagaggtaaccgtggaaggtgcttccacaccggattatccgttgcagaagaagcgtcacacgtttgaatatctgcgtaccatttcacatctgcgtccgagaaccaatacgtttgaggcggtgttccgtgtacgttccctgtgtgcatatgcgattcacaagtttttccaggagcgcgatttcgtttatgtgcatactccgctcatcacaggaagtgactgcgagggtgccggggaaatgttccaggtaacaacgcttgatttaaaagatgtgccgaaaaaacaggataaaaccgtggattatactaaggatttctttggaaaacctaccaatcttaccgtatccggtcagttaaatggagaaacctatgcgatggcatttaaaaatatttatacgtttggaccgactttccgtgcggaaaattcaaacacaaccagacatgcggctgagttctggatgattgagccggagatcgcattcgcagatctcgaagatgatatgatgcttgcggaaagtatgttaaagtatgtgatcaattatgtgattgaacatgcaccggaagaaatggcatttttcaataattttgtggacaaaggtctgctggatcgtctggagaacgtagtaaacaatgattttgcacgggtgacctacacagaagcaattaagatattgtcaaaacacaatgacaagtttgattataaggtatcctggggctgtgatctgcagaccgagcatgagcgttacctgaccgaacagatttataagagaccggtatttgtaaccgattatccgaaggaaatcaaggcattttacatgaaactcaatgaagacggaaagacagttgcagcagtagactgccttgttccgggaatcggagagatcatcggcggaagccagagagaggacgattatgataaacttctggcacgtattcaggacatggggctgaaagaggaagattacaagttttatctggatctgcgcaaatacggatcagccagacatgccggattcggtcttggatttgagcgctgcgtgatgtatctgacgggtatggcaaatatccgcgatgtcattccgttccctagaaccgtaaataactgcgaactgtaaaatggaataaaagagccgtatttcccataaactctaaggaggacaatttccggagaagtatgtgtggagaatgggcaggaacaaataaataataaaacaggaagaaacgtcgcaaagtttgcaggctgctttataggcacatgtctgctctccgcggcgctttttctgttatggtgcgggatttcctattccatgagattgtcggtggaactgatccgggtgggaattacggcatggtatgcgctttccggtctcatcggtggaaaaatcctgcgcgcatgtaaatgtggtgccatacctttttgcgcagttatgctgggaggcctttttttcgggattctgtatgtctgttcctgcatacgggaacagcactggattgcgctggagggagaaaacctgacgattctgattttgtgtacggcagcggcactgctgggaagcgtgcggtggaaaaagaagtaagggctgtgtgactgtaaaaaaagactttccttatggtgaccactgtgctataataatacagatagacgggaaatccaaaaaaacagacaaaggagagattctcatgaagcatgtaaagacattaaatacaagaaagttacagaacacaatcaagacaggtggatgtggcgagtgccagacatcatgccagtctgcatgtaagacatcctgtacagtaggaaaccagacctgcgagaagtgtaagtaatcacggagtgattacttacacagcccgaacgctaaggtaagaaaaataaggcataataaagccgcgtgcgtagcgcgcggttttattatgtttaggaaagagaggaaatattatagtggttcatcagtttaagaacaatggctatgatattgtattagacgtaaactccggtgccattcatgtggtggatgatgtgacttatgacgtgatcgcattatttgaagatcactctagggaagagatcattgcccagttacaatcccggtatccggaacaggagattgcagaagcaatcgaagaaacagagcagttaaaggagcagggagacctgtttacggaagatgcttacgaacagaagatttttgattttaagaagcgcccgacggtagtaaaggcattgtgtttacatattgcacatgactgcaatctggcatgccgctattgctttgcggaagagggcgaatatcatggaagaagagccctgatgtcttatgagacaggaaaacaggcacttgatttcctgattgcaaactccggaaaccggaaaaatcttgaagtggatttcttcggaggagagccactcatgaattttgatgtggtaaaacagttggttgcctatggacgggaacaggaaaagctgcatgacaagcatttccgttttacgctgacaacgaacggggtgttgctaaatgacgatatcatggaatttgcaaataaggaaatggacaatgtcgttttaagtattgatggaagaaaagaagtgaatgaccgtatgcgtccgttccggaagggggcgggaagctatgatctgatcgttccgaagttccagaaacttgcagaaagccggaatcaggagcgttattatgttcgcggtacctatacccatttcaacaccgatttttccaaggatgtactgcatctggccgatctgggattcaagcagatttctgtggagccggttgtcgcacagccgaccgatgaatatgcactgcaggaagaggatcttccggttctctttgaagaatatgataaactggcagcggagatggtccgccgtaacagagaaggaaattctttcaacttcttccatttcatgattgatctggaaggtggaccttgtgtgtacaagcgtctgtccggatgtggttccggaacggaataccttgcggtcacaccgtggggagatctgtatccgtgccaccagttcgtcggaaatgaagattttctgatgggaaatgtctgggatggcgtgaaaaacacgaatctgcaggacgagtttaaatgctgcaatgtctatgcaaaagaaaagtgccgtaaatgctttgccagattttactgtagtgggggatgtgctgcaaattcgtacaatttccacggaaccatcacagatgcttatgatctgggatgtgaactccagaagaaacgtattgaatgcgcaatcatgataaaagctgcggaagcggaaaattaaaggaataggaaggaagcaaacatgaaaaaaagcaagggcgtcgctataatcgcgattatcctggcctgtctgatcggactgggatattacacgagcacgattatgtctgcgacaagcacaagtcagaaaaaaactgacaacaagacggaagccgaaggtattaaacttggtcttgatctttccggtggtgtgtccattacttaccggatcaaggataagaatccatccaagaaagatatcaatgatacggtagcaaagcttgaagagcgtgccgagagttacagtaccgagtatgcggtatatccggtcggcgatgaccgtattacggtagaaattcctggtgtctatgatgcaaatgccgtacttgaggatctgggaagcccgggatcgctgtattttatcgtacagaaagattcggacggtaatgaaaactacagttatgacagttccacaggggaatacaaactgaattatgacattcagaatctggttgacaatggttctgtaatcatggacggtaatgatgtaaagtctgccaatgcagcgtataaccagacttcctctaccagtaccaaggagccggttgttcagctgacattaaagaaaaaagcagcagatgtgtttggagaggcaaccacaaaggcagcttcttccggagaatctatcggtatttactatgatgatcatttcatcagtgtaccgaaagtagagagcgcaatcaaagacggaagctgtgtcatcaacggtatgtctgattatgatgaagcggaacagcttgcaacatttatccgtgtaggtgcgatcaacttaaagctcgaagagatggaatcttccgtagcaggggcacagctgggtggaaaagcactttcttccagtgtcaaggcagccatcatcggtctgatccttgtgatgcttttcatgatcttaaattacagcttatctggtgtggttgcatccattggtcttgccatttatacaaccgtaacggtagctctgatttatctgtttgaaattacgctgacacttccgggtatcgcgggtgttatcctcggtatcggtatggcggtggatgcgaacgttattattatctcacgtatccgtgaagagattgcagcaggaaagtccgtactgacatccatcaaaacaggttacaaaaaggccatgtctgccatcattgacggtaacgtgaccacctttattgcggcactggtgctgatgtggcttggttccggaaccgttaagggatttgcatatacactgattatctccctgattgtttccatgttcactgcacttgtcatttcaagactgttaaatctggcattttatgcggttggatgcagaaacgagaaattatacggacgtgcaaaagaacataagaccatcgattttatgaagcatcgctgggtatgttttatcctttccctcgttgtgatcgtagccggatttgttggaatgatcggttacggagcagctggaaagggatctttgaatttcagtctggaatttaagggtggtacatccatctccgcagattttggtaaggattataccgttgaacaggtagaggacaagattgtaccggaagtcgcaaaggttattaatgataatgcgatccaggcaagtaccgtatccggcagcaatgttgtgacaatcaagacaaagacactgagcttgagcgaacgtgaagaagtaaatcagatgcttgtggacaagtttggtgtggatgaatccacaatcgagagccagagtattggttctaccatcagtaatgagatgcgttccaatgcggtcaaggcactgatcgttgcatgtattttcatgctgttttatatctggttccgtttcaaggacatccgtttcgccggaagtgcgattattgcactggtacacgatgtacttgttatgttaaccggttatgcattgatccgtatttctgtaggtaatacatttattgcctgcatacttacaattgtcggatattccatcaatgataccattgttatctttgaccgtatccgtgagaacatgcagggaatgaagaaacagacaccggaaacactggcagaggtggcaaaccggtctctgacacagacactttcccgttcactgaatacctccattacaaccatcatcatggtattgctgctgtttatcctcggagtatcttccatccgtgagtttgcattaccgcttatgattggactgatcagtggtacgtattcttccatctttattgcagctgcattatggtatgtcatgaaactgcatcttggcaaggacaaattgttaaaaccagcagtagcaaagacaaaaaagaaataaatattaaaaaacaggggagctgcacggcagctcccgtttgttttctaaggagtggaatggttgcattgcaccgaagaattcggtataatggggaaaaagagttgaaaaggagaatattatgtacacactggaagatatacaggcagtagatcctgaaattgcagcagcgatcactgcagagtttgacagacaaaacagccacattgagctgatcgcatcggaaaactgggtgagcccggcggttatgtctgcaatgggaagtattctgaccaacaaatatgcagaaggttatccgggaaagcgttattacggtggatgtgagtgcgtggatgtagttgaggaactggcaagagaacgcgcaaagaaactgtttggctgtgagtacgtcaatgtacagccgcattccggtgcacaggcaaacatggcagtacagtttgctattttaaagccgggtgataccattatgggaatgaatctcgatcacggcggacatctgacacacggttcaccggtgaatttttccggtacgtatttccatgtagtaccttatggagtcaacgatgagggatttattgactatgataaagtaagagagattgcacttgagtgtaagccaaagatgatcattgcaggtgcatctgcatatgcacgtactattgactttaagaaattccgtgagatcgcagacgaagtgaatgcggtgcttatggtagatatggcgcacatcgcaggactggtagccgcagggctgcatccaagcccgattccatacgcagatgtggtaaccactacaacacacaagacactgcgcggacctcgtggaggaatgatcctctgcagtgatgaggtaaacaaaaagtataatttcaataaagctatcttcccgggaacacagggaggaccgctgatgcatgtgattgctgcaaaagcagtctgctttgaggaggcattaaagccggaatttaagacgtatcaggagcagattataaagaatgcacaggcactttgcaaaggattacagaagcgtgatgtcaagattgtatccggaggaacagataaccatctgatgctggtggatctgacaccatatgacctgaccggaaaagttgttgagaaacttcttgacagtgcgcatatcactgccaataagaatacgattccaaacgatccgcagaaaccatttgttacaagcggaatccgtcttggaacacctgcggctacatccagaggattaaaagaggacgattttgatcaggtagctgaggcaattgccatgctcatcaaagagggagagccggctgttgagaaggcaaaagccatcattaaaacactgaccgataaatatccgctgcagccgatgcattaattaggaggaaccatgatagatttaaaatttttaagagaaaatccggatgttgtaaaagaaaacatcaaaaagaaatttcaggatcataagcttccactcgtggatgaggtaatagaactggatgcaaaggcccgggctgcgcagtccgaggcagatgagctgcgtgccagccgtaataaactttccaagcagattggtgccttaatgggacagggaaagaaagatgaagcagaagaagtcaaagcacaggtagctgcaaatgctgcccgtttgtctgagttagaggcacaggagaaggaactttccgagaaagtgacaaagatcatgatgacgattccaaatatcattgatccatccgtaccgattggaaaggatgacagctgcaacgtggagatcgaaaaattcggtgatccatatgttccggatttcgaaatcccatatcatacggatattatggagcgttttgacggaattgatctcgatgctgccggaaaggttgccggaaacggattttattacctgatgggggatatcgcaagaattcattcttcggtaatcgcttatgcaagggatttcatgatcaaccgcggatttacttactgtgttccgccatttatgatccgttccaacgttgtgaccggtgttatgagttttgacgagatggatgccatgatgtacaagatcgagggggaggatctctatctgatcggcacatccgaacattccatgatcggtaaattcattgataccatcaacgatgaggagaagcttccatatacactgaccagttattccccatgtttccgtaaggaaaagggagcacatggtattgaggagcgtggtgtttaccgtatccaccagttcgaaaagcaggagatgattgtggtatgtaagccggaagaatccaaagcatggtatgacaagctctggaagaatacggtagatctgttccgcagtctggatattccggttcgtaccctggagtgctgttccggtgatctggcagatctgaaagtgaaatcctgtgatgtcgaggcatggtctccgcgtcagaagaaatactttgaggtaggaagctgctccaatctgggagatgctcaggcaagacgtctgaagatccgcataaagggaaaagatggcaggaagtattttgcacataccttaaacaataccgttgttgctccgccacgtatgctgatcgcatttctggagaataatctgaacgaagacggaagcgtaaacattccgaaagcattacagccatatatgggaggaattgagaaaatcgttccaaaacatgaataggaggcagtcctatgggagatataaataagatggaagaagaatgtacccataattgcatgacctgtgggcatggctgtgcagaaggcagtgatggtgtgggaaaattcgaaaaagccctgaataaacttagtgatattgatgccggggagctgttgaaaggattacagtcgctgggagaatcagacaatcaataattgaaaacgataaaaaaagcaccgtatgaaattacctaaaaagtctttttgtacggtgcttttttgttgaaattgtacattttcgttgcttttcgtcagaaagagagcgataataaaagaaaaaaacaagaagaatcaatttgggtaggagagggtatgaaagaagtattaaaaagaggaatgctgaaatttgagaacagctttttttcccatgtcgtccgatgtgcattgggaatgataatcccacttgttttgacaggggggatttcctgtgctgtccgtgattttccggtcgccccgtaccagatgtttctgacgcagggggggtgggagatggttttatgatttccttacaatggtttatgagggaacatacggtattttttctgtagcattggtgattaccattgcgtacagttatgcaatggagaaaaatgaatcgctggaaaatgtcgttatgtatgtggttgtggcacttgccgcattcagcgcacagctgaatctgggaacagaagattttgatgtggcaggactgggaacgaccggatgttttgcggcaatgtttatcggttatttgtcctgcatggcattttcaaagctgcgcagatgccataaactgatgctggaacagtataccgcggggatggggggaggctgtgtcttggcaatccgtacactgattccactcggtattgttgcagctggttcgggaggcttgaatctgcttattggcagaattaccggaatctatggatgttatcagtggtttaaccgtattttctatgcagcatttcagaatattgcagattacagtaatttcctttccggactgctctatacgttcgcggtaaatctgatgtggtttttcggtttgcatggaagccatattctggaggcagtggcagtccataattttggtgtcacaggaaatgttgttttttcaaaggcattttacgatgtgtatgtggcaatgggaggctgtggcacaacggtcagtgtcctgattgcattgcttttgttcttccgcaaagaacgtaccggtaagctggcagggctggcatcatttacggtagtcttcaatttaaatgaaatgcttacatttggtattccgatcatattaaatccgattctgctggttccgtttgtcctgacaccggtggtgtgctattgcctggcatatgcggcaacagtatgcggttttctgccggctcttactcatgaggtggtatggtcggcaccggttggtatcggtggctatcttgccagcggttcatggaagggaattgccgtgcaggcagtgggaattctggcagggatattgttttaccttccgttcctgaagatgaatcagaggatggaggtatataaagccaagtgtcatgttcaggttctgatacacgaattacaggaaaaggaagaacagattgaccagccggtgtttttgacgcgcggagaccatatcggaatgatttcccgtatgctcctgcttgatttaaagcatgcgatcaagaataaagaactgtatatgctttatcagccacaggtatacagcgatggtacctgtattggtgctgaggcattgctgcgttggaaccatccggtatatggtatgatatatccaccacttattatttatcttgcagaggcgggaaaggtattgccggaactggaacggtttatcattgatcaggttacggatgggattgtgcagacgcgtgcacaatatgattcggattttaaaatttccgtaaacattaccgcgcattccctgttgtgggacgttgagggatatatccggcagactatggaacaaaaagggatagatgcccacatgctctggattgaaattacagaacaggatatccttctgcagacggatgtggttgtccggaaacttgaagaactcaaaaagcagggccataagcttttgattgatgatttcggcatgggacatacttccctgctgtacctgcagtcagagtattttgatgtggtcaagctggacggttcactgacccgcccacttttgaaaagccatacgaatcagaaaattgtgcgttcgattatcgaactgggacaggaacttggggtaaaggtaattgcagagtttgtggaaaacagggagcagagagatcttctggatacgctgggctgtcattgctatcagggatacctgtatgcaaaaccgctggaactggaggcgtttattacttatatgaaacagatgaacgagaagtagcgggctgttttttcaaaaatttccagtgatatttaccaaaatttctcttgtttttttgaagccctggatatatgatgatgacagggaaattgttacagcacaaaagccatttcagaaaggatggacggaaaacatgagaaagaagtcacatatttcactggcacgttatattgtagcaaacacagaggacgaagggctgaaaaaacactggctgtcgttttatattggaagtgtcctgccggattgtaagccatcttttatctataaacggcatgagattaccggtacatttccaaaactcaggaaggatatagatgcattgatccatggaaaagagaaacgttttccaaaacggaagcggatgtattacatgaacctgggggagatcacgcattacgtagcagattattttacctttccgcacaataagatttatccgggaggatttaaagaacactgtgcttatgaagaacatctcaaacatgaactccgcgcctttttaaagacggaggcaccgaaggcactgaatgaatgcgggcatcggcagtttgccagccaggaggcactgtttgattatattcagaagatgcatgataagtatttaagcagtaagattgatactgcaaaagacattgagaatattgtgctggtcaataaacaggtggtggatggtattgattatttgtttttgaaaaatcgtatgcagcacagagttgcatagcgcagaggaaaggcagtcagaaatccggctgtttttctgcgtttacaggcacttataggattgacaaatttttgacaaagtgttacgattatcccatatgaaactgtcgataattcgtgacagaaggtgcatataccgttacgaaagacatttaggattaggaggatttgtacaatgagtgagttcaagaatttaactctggaagtagctgacggaatcgctgtattagcaatctccagaccagcagcattaaatgcattaaacagtgagactctggatgagttaaacgtatgcttaagcgagattgaagcaaacgatgatatcaaagcagttatcttaaccggcggtccggataagaagggcaacgagttcaagtcattcgtagctggtgcagatattgctgagatggtaaacttcacagctccggaagcacgtgcattcggaatcaaggcttctgagccattcttcaaactgatgaacatgcgtcaggttactatcgctgcagtaaacggatttgcattaggcggaggatgtgagatctctatggcatgtgatatccgtatcgcaagtgagaatgccatcttcggacagccagagtgtggtcttggaatcattcctggattcggtggtacacaaagacttgcccgtctggtaggcatgggacgtgcaaaagaaatgatcttcacctgcgacaatgtagatgcaaacgaagcataccgtatcggtcttgtaaataaggtagttgcaaaagaagagcttatgccaacagcaaaagctatggctgcaaagattatttctaagggaagctatgccgtatctgttgcaaaggctgcaatcaacaatggctatgacatggacatcaagaacgctgttgagatggaggctaacctgtttggcgttgtcaatgatacacatgacaagaaggaaggcatgggagcattcttagaaaagagagctgctacattaactgatttctaaaagaaaacatattatgaggcgatggcgagaggctgtcgccttttttatatttataaaaaattatatacttgacttaaagtataggttgcgttttataataagaaaagatgatcaggagagaaaggaacgtccatcatgaagaaagtcattagcattggaaaacaggattttgcatatataagagaaaatgactgcttttatgtagataaaaccagtctgattaaagagtggtgggagggcaaagatgatgtaacactgattacccgtccgcggcgctttggaaagacactgaatatgagcatgttgaactgctttttctcaaatcaatatcaaaaccgaggggatttgtttgaaggactttttatatgggaggatgagacctatcgtaaattgcagggaacatatccggtaatttttctgagttttgcagatgtcaaacagacgaatggtgcagatgccattaaacaggtgaagcggattatttccgatgtatatgaatcctgtcaataccttgtcaaatgggagaatctgggggaaaggcagcgcagacagtttctcgaaatatgtccgcagatggatgatgtaaccgcacagaatgcgttaaaagatttgacaaagtatctggcaaagtattatggaaaaaatgttattattcttctggatgaatatgacaccccaatgcaggaagcgtatgtgcacggatattgggatgtgtttacagaattcatgcgtagtcttttcaattctacatttaagactaatccgtatttggaacgggcaatgatgacaggaattacaagggtatccaaagagtctgttttttcagacttaaataatatgacagtcattacaaccacatcaaatcgctatgcagattgttttggttttacagaacaagaagtattttccggattggatgcttatggactggccgcggaaaaagaagaagtgaaactctggtatgatgggtttacgttcggagaataccgggatatatataatccgtggtcaattacaaattttttgcaggagcggcagctgcgtccttattgggcttcgacaagttccaatggactggtaaatcaattgattcggacagccccagcacagacgaaagaacaaatggaaattttgcttcaggaaaagacgattgttgtaagttttgatgaacagatggtgtttcagcaattgggacaggatgacaatgccatctggagtctgttgctggcaagtgggtatttaagagtggaaaaagtagaatatcgtggattgacaagagaaccatggtatcatctgtgtatcacaaatctggaaacctacagtatgtttgccggtatgtgtaagggatggtttggcagggtatctgcaaattatcagggatttattaaggcacttttagatggaaatttaaaagaaatgaacgtctatatgaatgaagttgcactgacgacgtttagtagttttgacacgggcacacatccatcggcaaatgcacagccagagaggttttatcatggatttgtattaggaatgctggtagatctgcgggatgattatgatctgcgctccaatcgtgaaagtggttatggccggtatgatgtgatgctgattccgcacgagaagcacgaaaaggcaattgtgatggaatttaaagtgcatgatgcacaggcggaaaagacaatggaagatacggtggaggctgcaaagcggcagatacgggaaaagaaatatgatacagaactgatagaacagggagtgaaaagagaaaatatccggcattatggttttgcatttgcaggaaaaaaagtattgattggatgagtatagttttgtccgttgtggaagaaaaggaatgtctaagagaaagacattccttttttatgctgtgcacatgatatccagaatccatgggagagtattggatttacaagttgagatttaatgcttcccggaaaaagtggaaccagtattgttgaggaaataaaaccacacatagatacacctatcattgttgtctcggcaaaggatgcgttagacacaaaggtaaatctgcttctttccggggcagatgattatatgacaaaaccgtttgaaattgatgaacttgtagcgcgagttgccgttcagattagaaaacacagcacagataagtcagaaactgtctatcattataaagatatggttttgaacattacagaacatagcatctcggtttcgggatatctcatttcttttacccgatttacaggggagacttatacactccgtgaggaatttgcgccttacggctatctgaaagcggaggaaatccagtttacagtggaagataccgctgaaattcagagcgtagtgatgaaagatgaagttccgacaggcgcaatcatcatcaataaggacggcgaatttgtaacggacaccacccttatgaagggatatgtgaagtccgacaaggtattcgatgtggatgcgtcatatcagggcgatgataaggaagtaatcgaatttgaggcagcaatcacctataccgtagtggaagtggaggctccgaaagggtatcttcttgattccacaccgaagaaagtgaagtttgaatacaaggacggaaaaacgagagtggttgaatacacacttgaagtggtcaataagcctacagagccgaaactcccgcagaccggggacaacatgaacccgtgggtatttgcagtgttcgggcttgcggttgtcgctgcaggacttggcatcatcttctgaaaaaagaaaaaggaaggcgcagaagcataaggaaggaataaccatacaggaacccggtggggcatgtaagccagagcagcttatgtgccccgcctttttgcagaatggaaaggaggaacagattttatgcagatatgactattatattcacgtacctaaaaagttcttcatctgacaaatggggaattaaaaatactgcatcttatgggattgcagtatatcgcaaaagagggaatgtttgaaggggatcgtgggggttatatgataaaatttgggagactccgttatgattccattgaaaaactgatccgtaaatattataaacggacagagaaacaagagtctatggcagcaatggtctatgggaaaattaacaatctgccacggatcagtgagatgttacggacagaatctgttttgtatctatatgatattacagcaaatccagaacttcagttaaagacggactatctgcttgtaaaccagcagcaggatgcggttttacagttaggcattataaaagaggttaaatcgaaagagcagatatgccattgcaattcttttatggtggattataagaataatgaggattatgatctgcattacagggatcttacacactgttatgagattaacaagattgtccgtgaagaaaaagaaacaaaacgggcggaggtcatataccaaagcatggaggcggagcagagagaaaaatccggtatagagaaaatgcttgcagcggcaggcatatacgcagataaaaaactcttaaatcttatcttccagttgaataagaaatttggtatataccatacagtggatatactgaatgacaatgaggctctgcttggaaagtgtacagataaaagggagaagaagcttgtatcagattttctggcattatgggagaaaaaagaagatggcatataagcaggaattgtgggatgaggcgaagaaaagatgccatatcggggacgaagaaatccgcatggcaaaagaaatggggttgaatcccaaaagccttataaaaaatatccccaacaagagtgagcagtggaaagcccccgtgaaagactggatacacgatatgtatgataagagacagagaaaatcacggcagaaggaaaaacggagggcagaacaactgaataaggacaacaatcacagcatctaagccaaatggtttaggtgttattttttgccctgaaacggaagcggtgcagaaaaaagtgtttcggaggtgcagtttcgttttgtaaccaacacatcaagcggcatgggacttatgaagtgcggaaatgtggtaaggataattttgttgtggattacaagaaccgcaatgatgagcgcaggaaagatgccgtaacctacgagcagctttattcggtcatggaatatctgataaaagcgcagatgttcaccggggagataagaatgtcggcatacctgcgtgatcatgcgaggctgccgtatgaaaaaatgtctgcactggaaaagcagtttgacgacaaaatgaccagcctgcggaacaagcagcacaaaggtaacttccactttgaagaggctgaactgccagaaggaagccttccaaagaaggctgggcagaaaacaagatatcagtggaacgtggaggcaatccggctgttaaagcagattgagcatgagggcaggactgccacaccggaagaacagaaggtgcttgcccggtatgtgggatggggcggcatagcgcaggcttttgacgaaaggaatgagggctggcagaaagagtttggggactacaagttctatgacgcaaaatatgcaaagcacaatttccgtatccacgattactttttcgcaaaggcactggataaggtcagaccgggcggcattgtggcattcatcacaagcaactgctccgtgagaataatatgcaggaagccgccaacaatatctttgaaatggcagcgtatgtcgatgtcatggagaaaaagatggattccgttttacaggagcttgtgacagtcaaggatcagtttcgtaagatagaagagcaggaggcggagaaagggctgaaacagtcactcaaaagagcggtaaacaagctggaacaggactgcaaagccatgaaagaaaaactgtttgaggtcaagacacagagatcaaggcaaaggcaggggaaattgtaacagcggtaaagcagaaagggaaagctgccttaaataaagtggcggattttcttggggttaagaagaaattagaaaatattcgccagaacgtgcaggagtccatagcagatgtggataagagtattgggaaaatagacgctttgggcacaggcatgagggaagcaagacagaagattgcaaacacaatccgtgcttttgcggataaaccggaaaaggagtatggggagaagaagttttcaaagacagaactgataaagaagccttttcaggctaagagaaagctgatgtccggcatcttaaactgtgcggatgccaccatagaaaagacatagcagcttgccgcagacgtgaaacagtatcagacggataaggcagaacgggaaaagggcagcgttgacagcatggatcctgttaatccgattgaacttgcagtagtggcagagccggagttccagtatggggcagaggttttcgaggcacatcagcaggaaacagtaaaagcgatgacaacggataaagcgacgaagaatgtgcctgtaaagagcggaaaaagccgatagggaaaagtcctcttgaattgaactaaggtttgattcaaggggattttttgtttggatggtcattttctgcaaaaatgggacactttctgcaaagccacttgtttaagatattgaatgtgtctacactacaaagtaggaggtaaaaataaaattaggaagattaaaaaagtttttagtagagttaaaaaaattgatcgcttcaaatagggtgattaaaaatccgtaagggtgttttttcattttgttgtatcagcaattattgaaaaaagcaaatattttaaaggaggcatataatatggctatggaaattaatgaaattcgtcctgattatcctagacagtatccagttgtaaacaaaacagaaaagagcgaaaatgatacaccagtcaataaaatcccgcaggatgagtatataagtagtgaaaaggcagcaaacaaaccgagcggcttgtatggattggcacaggatgaaaacggcaatcgtaaaattgtttatgatgatccacataaaaaggagcgtgctacttctgatggggtaaaatcggcagatagagatgataagtcggaaaaatgtacaacaaatacagattctgttgatagagagatagagaagctgaaagaggaagaaaagcaaatacaacagcagattcgtagtgctaatgtaaatgaagaaaagaaaaaagaactggagcgtaagttggcacaaattgaaaacgagttgtctcagaaagatactgatgcatacaggcgccaaaacgcagtaacaaataatgcaggttaaaatggctgaatgcttataagtggtcaatctatacaatgaatgtttgagattggcgtgacttataaatatagcctgcaaataaaaagtcaaggctaaattaaagaacattgaaaattttatacaggttgaaaattaggtatcaaaataagaccaccacaccagtgctggtctgaaaattataatgatgattaggattctggaagagatgaaagatattctttcactcgtccgtaatagattcttagaaacttgttggcacctgcagtcatatagacatagtaaggcttgccttgtgcccgcttcttgtctaagaactgatacacaggatcatcctgtgggtgtgtttttattaaaacatccattacctgaaataaggtctttctaagatcagatgagcctcgttttgaagttggaacacttttttgttcataacttcccgattcattaacaccgggatctacaccagcaaaagcagtaatagcacctttatgggtaaaacgggaaacatcaccaatctcagccatcaattgaggaccaagcgaagcaccaacccctttcatcgccataacaataggatactctgggagtttggatgcagtttcattcataagtgtgcgtagtgattcaacggttgtagaagcactgttaagctggtttacagcctgcttgataataagctttgtaatgtcatccttaggaagtacaggaacaagttcctttgcttttccatagatttcctcagctttggattggctgaagttgtacttcttacgtttgcaccagttttgataatggacgataaaggcattcagagacattttacggacacagtccacatgccagtatgtagatgcaaaatcaacccatttctggctgccgtcactgcgtgcaggactgtcaaagtaagtattaacaccaggataggtttggtcaaggatgccgataagattatttttcatagccgtcttgtgcttcatgtaaaaaccgaactgacggttcatggttttgagctgattgcgtaattcatccataacattatactgtttaagattttgccatttgtcaagagcatatcgggcaatcttaatagcatccgctttatcagatttcactttacgaagagaatcattatcaaagtctttgataagttttgggttaatggcactgacgaaaagatttgcctctgaaagctgatgggcgagggcttcatagtaacgtcctgtgtgctccatcacgattcgggactcaccttcaacagagttgatgagttctacaagtgaattgatatcactggctgtgtgtttgatttcgaaaggtgcggaaacaatttcaccgaaaggccgcatgatagcaaccatactcttaccttttgaaacatcgatacctactgcgttcataaattgtcactccttaagattattgcaatggataaataccagttttactcattgcctattcaatctactgtggtgtgacgcgaatgcacctatggcgattcaacctgcataaaacgaacgctgcgaatgaggagctggttatcagtctatttaacggacgcaaagtccaagaagggaagacgatataccaattgccccatcattatacagcttaagcaacaagatggataattccttactggctgtaagggatattaaccataaatatattgtagtagaagggaaggaggtatgcatcatgaaaaagcagcttaagaaaaaggttacagtcgcatcaaagcagcatgtaatggcacactgctcatgcacatgtagttgcagcttgaacaacaactacaatgcatcttggggaaaagtaaattatcattatatttaataagtgatggcttgtgaaaatatagtgaacaatttattttgttgccaagtatgtgggggctgatcataaggtcggctccctatttactaatatttaatgtcattggaattttgttaattgaggtgacgtgaataatggatgaaataaaggtagcatttcttgatgacggattaaacatgagtttgctttctgaaatggaaaaagtggatttatatgcagtagaagatggcgaggtaatattatgctcaaatataaatagaggtcatgaaataactcatggaacaatatgtgtaaaaatttttaagcaatttgtaaaaataaaagccaacattattagtatagaaatacttgattataataagagatgtagctcagataagttagtagttgcattgaactggattgagcaaatgggtatcaaaatagtaaatttaagtttgggtacatctttttttggggatgaaatgtgtttaaaacgatgtgttaataaactagctgatagtggtcacataattgtggcggcacagaataataattcgtttattacatatccagcaacttttacaaatgtaataggagttagtgctagccatgaaaatcaagatattttgctaaatacagaatatgttttttctggaattgatttgttgggaaaatcggaacatgaaattgatatgcagggaaataaaattgtaacacaacacgcaagtagttttgctacaccatacataacagcgatggttgctaatttatataagcctggggacgatgtgctagatatgaaacacaaattgtgttcaacattttgcgatggttttcttgaattgaaaaagtatgactggtgtaataaggctattattgtacaatcacgaaattgtaattttgaaaaagactatgtatgctttgaagtgattaaaagatattatttcgatgaaatcgaatttaaaatagaagaaattaaaatattatataaacagaatataataaaaactttaataataattggaaatggagagaacattatacatttgctaaaaggcgaaaaagttaggttcccttacctattaatgataaatactaacaacgaaattttattatctaaaatgaacaatttagagaggactcttatcataaaggacctgaatttgaaaaaaatattttcaaatgaaaaaataaagaaattagatatacctatagttgttatatattacaatgaacagaaagaaaatgaagcgatatgtagaatatgtaaggctaaagaagattttgcagataacggatataattgtaaaacatttattgacaaaagtgtgggagttttatatagttttgaatattggactggtgaatttgatattagagaatatattgagttttatatgatagacttggtagttatactgataaatatgaataaaaaaaatggatatatagatggtgatttaaatctgaggtttgggcaatcggaagtttttagtgaaataaatatgcttttcgatgtagaagacaaggatatatatcagtataccgtagaacaattacaagaggagaacaataagtatgaataaacaagttaaccctatctataaactttttcaaacaagtaataatgatttttatatgtttgatacgtatgcaaacaaaatcaaaaaggtaagtagaaattgctatgaatatttacgcaaattagaagaagggaaggcagatttttttcaagaagcagccattatcgaggatgaagaatttaaaaaattttatgaagaaagtttagaacaaggattatttgcaaaatattgcattgaaaaacttcagcatccaatgacagaacttttagatgatattttggatgtaaatatagagagcataaatttgcaagtaacacaaaactgcaatctaaggtgcgaatattgtccatatactggcaatttttataacaacagaagacatacaaataaatctatgagctttgaattggtaaaaagaggtattgacttcctttataatcattcaatgaattgtgaagtcgtaaatgttgctttttatggcggtgaacctttattggaatttgaattaatcaaaaaaagtatagaatatgcaaaagaaatatttagaaccaaaaaaataatattttctttgacaacaaatgcagtattacttactgatgcaatgatgagattttttcgtgagaatgatgttctgttaacagttagtttagacgggcctcaaaatattcatgataaatctagaatttttgctaatggaaagggtagctttgaaatagtatatagaaatttatgctattttaaagaaaactatttggagtattttaaccataatgttatgtttaatgctgtaagcgcacaagatcaaggagtaatagaaatagataaattttttacggaggatcccctctttgaaaagtgtgaagtagctacaacattctatagtacaaactatgtaagtaatgagccacaatataataatgaaaatgataaatttgtacagcatatggagtttgaaaaatataaatgctttttatacatgatgaaaaggataaaaaatttcccaacaaggatgcagataaatagttttgaagaaattaaaaagacagaaaagcatctaaagggatttatgggtatacctaaaatatttcatcctgcgggtccttgtgttccaggtagaaagaaattgtttatgaatgtggatggcaatttttatccatgtgagcgaattgatgagacttctccttgttcagtgattgggaatattgatgaaggattatcattagaaaaatgtgaaaagcttttaaatattgggaaaataactgaagaaaagtgtaaggggtgctgggcgatagctcattgcaaattttgttttattcaagcagatagtggaggggaactttgtccaaaatgcagattggaaaaatgtagaaatttacaagattctataatagatacatttagggatatttgtgtgttagaaaagaatggttatcattttgaggaggacgtttaatgaaaaataatagcgaaatagcgattgtttatcctatgagtaaagaatttgtggaaataataaaatatagaaaaatgttagaaaattatgaaaaattaattccggtgtcgtttattggacaaagtgtagaaaatagagatgttggagaactagtaaaaggaagtcatattggcatagaaataacatcggactttgaaaagaagatacttgatgcaacagagattatttttacagaattttcagacattgtatatgagaaaataatgtactcaatagagaaaaagaaaaatattgtttgtttatgtgagttagaacatggagtggaagaaaaaattatacaaaaatgcaaagaaaaaggtcttatatataagaattattgtaaactgagtgaaacttatcctgaattaaaagaaaatagattaaagcaagtatgtgccccgatattattgatttgtggattatcagaatatacaaataagtttgaattgcagcttaaaataagaaatgagtttattaggcgaggatattcagtttctcaagttgggagcagaaagtacagtagtttatttggaatgcataattttccgcagtttatgtttgatgatattcaggatagtgaaaaaatatatcttttcaattcctatgtaaaacaaattgaagataaggaaaatccggatataattatcattggtgtaccaggtggagtaatgccatatgatgcagatcatccaaatggctttggcattgtaaattatttggtttctaacgccctaaatgtggattatgcacttttatctttgtcttataatgaatatgatgagtctttttggaactttgtcataaattatatgaaatttagatatgaatacccagttcaaagttttcatttgacaaacatttttcatgatatatatggagacgaaagaaatgatcgggagagattaatatatataaatcagaaaaaggtagaagaaaagattaaaacctttgcaagaaaggatatatttagtctaaacaatgaggaaattttcataagtaaaattgatgagataatagactatttatctaattagaggagatttatcagatgactaataatatagaaaaaagtgtgttaaataagttagaaaaaaatttttccattcaattaacacaaaaaatgtacgatactaatttttttaatcctaaagtaggtttacctgcaagacattttattgatttaatatatgaaatggagaatgaatttagtattaaatttgatgaacaaactttgataagcccagagttctgcacattaaatgggtttgtaaaaaaaatagaagaaaagataaaatgttaagcagaaagttttacgaaaatattattaggagtagatggagataaacatgaataacagtgaagctgttaaaaagttgcttggacttttaaagggatatagtaaaactatagcagttattattggctgcctcttaatttctaccggattgagtttatgtatccccttgcttaataggcaaatcatggatgaaggttttattggtgaaaataaaagcttattgattgagctgacgctgatactaatggcaatatatgggataaactcaattattgatattattaaagaaaagaaaagagtagaaatttctgctaagttacaatattttctttcagagcagtcttttgcgcatttaatgaaaatgaaaatgagctattttaataatacaaattatgctgaattattaaataacatcaatacggatattggtaaaatggttatgatttcagatgaaagtattttttttgttgttacacagacgtttaatatgataggcgggttgataggtcttttcataatagactatagaatgtccatacttgtaatcatatttattccaattaaatgtattgttatgaagtattttgcaaaaaagcaaaagtctattatggaagattttataagacgtaatcaagagtatgcaaaatggtttggtgataccgttgagggaattaaagaggttaagttatttaatatttttgataaaaagcacaatgagtttttaattaggcagaaaggaattatagataagcagaagcaaatgaatatgcttagtcagtggaatattattactgattcaataatggttcagttattatctacggtattatatattgtaggtggaagtttggtgtttgacttacaattatctgttgggagtgtttttgcatttattacatatagttcttatgtaacaggaccaatatcagcaattttaaatatcggatatttgctttcgggtataataccatctacaaaaagatattatgaatttatggatttacaagaggaaacagaaagtggaaaacatctagaaccaatttttggagaattgagattacaaaatgtctctttttcctatgaggtaggcaagcctgtacttagagctatcaatctaacatttccaaagggaagcaaaacggcattgatgggcaggaatggttctggaaaaacaacaattattaatctgcttacaagagtgtataatccggtaagtggttatatattgttgaatgagacggatatttcagaaatatcattacataagtataggaacatggtatctgtcgtaagccaacagatttatctttttaatgatacaatcagaaataatatatgtctctatcagaatgttagcgatgaagtaatacgtgctgcttgcaatgagagtggcttggaagattttttaaaagaagtgtctttagattatgtggtaggacaaaatggtgcaatgctctcaggcggacagaaacaaaagattgcccttgttagggcgttagtgcatgacaagcctattataatttttgacgaggttacttctaatacggattcttattcagaatatcagattaataacttattacatacaaggctaaaaaataagacagtaattattattacacataaaagagagatacttagtgaggtggatcgaattatcatgttaagagatggtatcgtagttaaaaatgaaaactatgatgagctaataggtaatagtgatgagtgatgaaatatcttggataattaatatgttatttttgcaaacaatatttatgtgtaaaaatatttgtttttttacttcataaattatttatctaaaaacagtaatttgcaaattcgagaaaaatagaatgaaaaacattattaataaagcagacggttatgtagcagtatatgccgaatggtatgatgaaattgtgtaggatatgagcgaaccatgcggtctacaactcttatttttatctagatggggtactagatttttcagcaatgtttaaccttaacacatttagttgttcaatattaattaaaggggctgtgaaaaaagaatagtcccgaaaaaagaaagaccaagagtttataatgaactcaaggtctttctttctgttataattaacttgcaatgaaaattaataacataatctattctaacccaaaacaggcagttttgccaatactaattcaagattatctggacatctgtgatccggtgctgacatttgacagatttatgggagaaatcgaactggagaaatatctgaaaaatattccgcaacatgatacaggaagactcagatatgacccggtcagcatgctgaagacagttttgtttggatttatggcaaatggctatatatcattacgtgagctggaggatcagtgtaaagtcaatctccgcttcatgtatctcatggatcatcaaacaccttcttaccgtaccttcggctactttataaacgaggtacttgctgattccatagaagaaatatttcaggacataaacaaaaaaatcttcgagacagaacacgtggatctccaacacctatacattgatggctccaagtttgaagcaaatgcgaataaatactcctgggtatggaaaaaatcaacagaaaaatccagataccgtctatttgataagatcaccacactctttgaggaaatcaataaggaactggaatgtacgggtataaagttttgtatcaatagcgagtatgcgccagagtatctgaaagaagctgctgaacagtatgcagaagtctggcagattgatgaaacgatgtttgttcatggcaggggacatcgcaaaactacgcagcaacgtcattatgagaaactcagggagtatactgccaagctggaagaatatgtagaaaaaatcaggatctgtggagaagatcgtaatagctactcaaaaacagatcattcagctacttttatgcgaatcaagacagactacatgggaaatgaccagctgcttccagcttataatgtacaggttggtgttgcagatgaatacattgctgttgttgatgtaaatcagtaccgttccgatatggactgttttattccactaatgaacaagtttcagaatatatatggtttctatccaaagtatccagtcgcagatgccggatatggttcttacaacaattacatcttctgtgagcagcatggaatggaaaaatatatgaagttccccatgttcaagaaagaaactactgacaagaagtatcatgaagatccatttcgtgcagtaaatttcccaatcggggaggacggaatcatgcgttgtccaaacgggaaaagcttttatcttcagtatcgtaaaaatgtaaagggaaacaagtatggacgacaggaagaagtatatcagtgtgaagattgttccggctgtccatatgcagaacaatgtaaaaagacagataaaaaccgtaccgttcggctcaaccatgaacttacatcgatgcatcaggaagtgattgaaaatctcgaaagtatcaagggagcgcttctaaggatgaacagatccattcaggccgaaggtacatttggtatcataaaaaacgaccgttggtataaaagaattgtccgaagagggataaaatctgtattgcttgaagtatttcttgtttctattggacacaatctttataaatatcacaataaacagaaaaaagtcgcaactgccgcataggattccataatagcattcttatggggaaagggggagtatacacttttttataaaatataactactgttgtatctataagcaaaaggacgcatgaaaaaactttcgttttttcacacgcccttcagactgtagacaaagtcctcggctttttgccgaggatttttctgtattaaagaggctaaaagtcagtattttcaagacttttcagtctctttttggtataataaaggtatcaaaaaaggcggtattgttctatgatgacacaagaaacagaaaaagtaagaaagcaaatgcagatggtatgtattgatgatcttgttccgcggaatcatcttctacgacttattgacaaagctattgactggacattcatctatgatctcgtccgtgatacttattccgacggaatgggtagaccaagtattgatctggttacgcttattaagataccgcttattcaatacctgtatggaatcaaaagcatgcggcagacaatcaaagagattgaagtaaacatggcttaccgttggttccttggacttgaactttatgatccggtccctcatttttctactttcgggaaaaactatacccgtcgttttaaaaataccgacttattcgagcagattttccagcgtatccttgaggagtgttaccgtttcaaactggttgattcaacagagatttttgttgatgcaacacatgtgaaagcgcgggcgaacaacagaaagatgcagaaacgaatcgcaaaacaggaagctttattttatgctgacatgctgcgtcaggacattaacgcagacagagaagcgcacggaaagaaaccgttgaaagataaagacgataacaacaaacctggttccggtggcaacgacaagtttgaagattatacggatgatgttccgtcagatgaaaaaacaattaagtgtagcactacagatcctgagagcggctggtttcggaaaggtgagcacaagcatgtgtttgcttatgggattgaaacagcatgcgataaaaatggatggattattgattttacagtaaaccctggtaatgagcatgacagtcgaacttttaaaggcctttacgataagcttgcagatatcggcatgaaatactgtatcgttgatgccgggtataaaactcctgcaatagcaaagctacttttggatgatggaataaagccggtctttccttacaagcgtcccatgacaaaggatggctttttcaggaaatctgagtatgtatatgatgagtataatgatgcttatatttgtccagggaatcactttctgcattacagcacgacaaatcgggacggatatcgcgagtataaaagctgtggacagatttgcgaaaagtgcgagtatctttcgcagtgtacagaaagcaagaaccatgtaaaagttgttacgagacatgtatgggaagactatatggaaacatgtgaggatatccggcatacagaaggaatgaaggagctatactcacacagaaaagaaacgattgaaagaatctttggaacggcaaaggaaaaccacggatttcgatatacgcagttgtatggcaaagcgcggatgacaatgaaagtcgcgcttacgtttgcgtgcatgaatttaaaaaagcttgcaaaatgcaagcaggaatggggattacggatggcataatccaagggaaaatttcctgttttcggaataaatttcataaacacaaagaaaaatgctccgagaaacggaagtttctcggagcactttgtctacggtctgaagggaacagattataatctgttccctttaatagttggttgtaaattatagtattactgaccgttttctgcaataaaaattacataaagtggactaaaaccagtcccttttcgatagctctattgaatacaatactctaaaaagaaccgaaatgggttcagaggtgtggtgatgacgtggagcagaaaataaagcaggatgaaatatttatcgggcagaatatcaggcgtatcagaaaagaaaagggtaaacgtcaaaccactcgccttggataattagcatttttgtgagacactctaaaaaacacgaaaaaactaatagttttttagaggaggcaaactatcatggatcaactcacacacaatgtcaggcgtgccaattggttaaacatcataaaacaatgtcaggaacgacctgcaaacgtaaccgtccggcaatggctgaaagacaatgacatcaaagaaaagtcatactattactggctgcgtaagtttcgcaaagaatcatacgaccagatgcaacttccagcagctactgaagaacctgcggaagtttcttttgttgaattcgcagctcccacatcggagaaagttgtttcaacacaaaattcgctgaattcaactacgaccgcggttatccgacatggagctatcactctggaaatatcgaatgctatttcagaggaagtactgagtctgctcctaaaggaggtaatccatgctggagaacgttgctaaaatcactcgtgtcgtacttgcgtgtggaacagttgacctgcgcaaaggcattgatggtctctcggtgatcattggtgataagtataagcagaatccgtttgaaaaaggaaccctgttcctgttctgtggcaggcgctccgacagaatcaaagggctgctctggatgggcgatggatttcttctgctgtataaacggatcgaagctggttcgttatcctggccaagaaccacggaagaagctgcggatcttactgaggaacaattcgattacctgatgctcggtttaaatccgcttgaccctaagattaaggatgtcacaccacaaaagccattctgagtttgtgcaaaacagagattttttaaagacatttatggtgctgtaaaaactatagtacagcttcgattgtaagccatctttgtcactgctatgttggctggaagaggcttgaaataaatatttcgaactttgaaaactctatatttccttgcttttattggcagtatacagccttacgtctgtaggcataatgacgaagaaccagcacataagcattcgctaattaagctcacttctgctataataaaatcagtttgaaggagcgaagcaatggcacagaaacacactttggaagaactgaataattgcagccgtgaagaactgatcacgattgttcttatgatgcagggcagcttgatgctttaaatgacaacatcgaaaagctcattgagcaggttcgcattgccaacaattacagatttggcaaacatacagagaccttaaagtcaatcgaaggtcagctttcattttttgatgaagcggaggctgcctgcgatgaatcaaaaaaggagccttctgcggaagaagttctcccagcaaagcgtacagtgaagaaaaaaggacaacgggatcttgatctgaaggatttcccggaggaaatacttccgccgtacagtgtttctgaagaacagctggatgctttttatggaaagaacaactggcgccgtatgccggatgaaacctacaaaaggcttcgccatgagcctgaatcatggacggtcgaaattcataccgtcgaggtatatgtaggaaccgatggtgatcatcaggatgaatttctgcgtggaaacagacccagggatctgcttcgcaacagcattgtaacaccatcattactggcttccatactgaacgtaaaatatgtgaattcatccgcattacaccggattgaacaggaattccaacgtaatggtgtgaatatatcacgccagacaatgtccaactggattgttaaatgctcccagatgtatttcactccgttcgttgagcggatgaagcaggaactgctgtcgctgcatgtcacgcagtctgatgaaacaccaacgcaggtgatagcagacagcgaccaccccaacagtaaatgctatatgtgggtgcaccgctccggagagttttataccaggcgtccaatcgtggtctatgaatatcagaaggggcgtgatcatcaaaaacctctggatttttacaaggactataagggagtccttgtaactgacagtttgcagcaataccatctggttgacaaaaagctgccagatgtaacaaatgcgaactgctgggcacatgcaaggcgtgattttgcagatgcggttaaggctgcagataaaaaggatccgtcgtcggtaagacaatcggttgcataccaggcgttgcagaagatcgctgaattttataatgctgatactgagctaaaaggactctcatcaagggaacgtcttcaaaaacggcaggaagtgattaagccgatggttgaagaattctttgcgtgggtaaaacagcaggtaagcgattgtacagtacctccaaaatcaaaaacagggcagggacttaatttcgtaatcaatcaggaaaaatacttacagatatttctcgaagatggcaatgtgcctatcgacaattcagcttcggagagagctatacgaaccttttgtctgggcaagaaaaactggatgttccacaataccgcaaaaggggcatctgccagtgcaatggtatatagtatttctgaaaccgcaaagctgaatcagctgcgaccgtattattactttaagtatatccttacagagttgccaaaactctgtgatgaaaaaggaaatatagatccggcaaaactggatcatctcatgccatggtcagatagtcttccggacgaatgccggaagccgcgccgcccataacaggcggcgttgaatttaatgactggcgcatgatttgacgtttacagaaaagggtatgcggcaaacggaaatggtagcattgatgcagttagagaatgtcccactgacaagggaggcgttagtgaaaatagaaagaggaatacagcacatacaggcatcacagcttagagcgatcagaaatgtattgggtacaacgtatgatgaattgctgaaattaaaaagacagattggtgtaatttgccattttactatcatattttacatatctatccgaatgatagcaattcttttattgctgctataaatgaatttgaagaggaaacgatttctttcagcgtacattcattacagtccggtatttgtgaaagcatactgatatcatactgatattatgctttttccataagtaagcagcatttttccccggaagaatctcaaaaatgaatttatcctgccaatcgttcaatacaagcccattttctttcagaataaaataggtctgcatcagcaggtttgatgatgtaaaggaaatccagaagttaagtggaatgggtctggtggcatgcagctccggcaagcataaaggacagacaaagatcagccacagaggacgcaagagactgcgttactggctgtttcaggcggcaaagtcagcagtgtcgcatgcggatgaattcaaacagctgcatgagtattacacaacccgaagcaaccatccactgaaaaagatgcagtcactggttgtgatagcctgcaagatactgagggtgatttacacaatcctgaagacagggacaacttatgatccgcagaaactgttgaaagatatcaaacgcccggtagaagcacaggtaccgatggcaacataggaaacaaagatatataagtaacacactccagaactctgtcgagttgctgatgggaggcatcagagactggacagggttctggaatagaaacccgtaaatgatggagtccggaacggactgcatctgcaaaaggccaacaagaacctgagatggtatagcgtccactgagtaaatcagtaccacgacagatgaatgcagatcagtaacaatcaaacataaaaacaagagctgtagccggcatcggttttttccgtggggcatgaccccgtctaggagtttggctggcacttagtgtatggtagatgggacgaaggaagttgggacaagatccccttagacacggaaggttcatcatcatagttgatcagaggggaaatagcctttataaagcaaacaaaaaggatgctttattagctatacttatttatcaactattcggtacatgatactacgatatccatcactctcggcttttgttttgaggtaaataaaaatcgtcaaggccagtaaaatcaatagatttaggcttgacagaataggaaggaaagctgcgaaaggtacataacaccgttccgtatcagagcattttgcaatcgcttcgacatcggaacatcataaattgatatttcgttacttggtggcagcagataacctaaagcgtttaattcgtcaatcaggggttcaatattataattttttggaaatttatttatcagagtaatataattttgtcctgcaagtcctgaaaccattgtcaagcctatactttttagtgcggatttagaggatgtagaaatatccaggtcttgaattttcatatctatatcattgctcctttattctttggattggaatggaaacaatcctagtttagcacttttttctgaaaaaatgaaacaaaaatggactgaaacgggttcttattttataatcttgattgttacaattcatgcttgtatcattttctgcataatatggtcgatttctgcaatttaattgactaatgcgctgaagaaaaataaaaaggggttttatattattttgtatatcgcccttccttattatgaatgtaaggaaagggttaaggaatttagtaggatgtgtcgaaatacaacaagatggattataaaatatcagggacagactactgtcaaatagcaggaaaggaggagacaacatagatgttcaaaattgcaatatgtgatgatgaaagtctttttacagaagaactaagagaattgctctccggctatatgacggaaaaaggtcctgcttttgaaatagatacatatagttccggggaagcactgatagaattaggaatcaaaatagtgcaatataatgttgtgtttttagatatcaatatggagaaagtcgatggtatcaggacggctgagatgatcagaaaagtaagccgggaagtgtttatagtatttgtgaccgcatatgttgattactcgctggaaggataccgattagatgttgtaaggtatttattaaagggcaatgccaattttcagagcaaaatcaatgagtgtatggatgcaattttcgataagatgaattattccataacgaaaaggaactttgactttaaagagggcagcaaagaaatatcactggaaagattattgtatattgagagtaatctgcatagacttgagtttcatgttatggaggacaaggaaaaagtttataccatgtatgaaacattaaatgtgttggacgatatgctttcagaaaatggatttatcaggacacaccagagttatcttgtaaatgcaaaacatattaagaatgttgtacgctgtaaagtgatattatcaaatggagctgagttatccgtaccgaaagtaaggtatacagaagtcagaaaaaagtttatagcgtgccggggagaagtgtagatgtttgatttaattcagaatgtattgttgatatttattgaggcaatgtgttgtaagactttttttgaaacttttggtaaaatacggcataatggatggattaatttaatacaggttatgttgttgttttatagtatgtgtttttattcgtatactttatctgaatattttgtgctaaggcaggttgttgcgatttctgtattttcagtattgatgttttggcatattaaaattagtttaaaaaaatctttcatattggctatattgtttgatgcattattattggcaatggattatctgatatatttgatttgtagctggttttctttaagcaatgagtcgttagggcagcagtatgaaattggatttgcattggtttctctattggcaaaggttatattgttttttgctgttctcattattagaaaacagtttggtaaaaaatcaatagaaatgatgctggatgcagaatggataaggtttctattctttcctgtgtttattatagcagcgatttctgcaatgttgtctgtttttgggtatgtgcagacagtagaacaggcgagtctattgtttattattgcatttggaatgataggaatgaatatcgttgtatttcatttaattaacgatgttgtggaaagggaagcacagatgcatgagaacaaggtttttcaaattcaggcgaaaaatcagttggagatgtatcagtctatctctgaaaattttgataatcaaaaaagaaagacacacgaatacaaaaatcagattttatgtatagaatctttgctagataaaaagcaatattccaaattagaagaatatgtaaaaaaaatttatggttctttgaatgatgaaccagatgctattaataccaataatgtgattgtaaacgccgtacttaatacaaagtatcaggaggcagacgcaaagggaattgtttttgtgttcagggtgaatgatctttcagaactgaaaataaaagatgaggatgtggttactatccttgctaatcttttgaacaatgctattgaagcgtgtgaaacatgtgaggataaaaaggtaattaggtttaagttcgttaaagaagatgacatgataatcattgctgttaaaaatacgtttaattatgacgttatatatgagaatggagagataaaatctacaaaaacatcaagcgtggatgaacatggtgtaggaatcaagaatgtgataaaaattattgagaaatatgatggctcatatgttattgaagataaggataaggaatttttcttttcaattatcattcccacatgaatgcaatgataaattgattggttataaaacttttctgtgccgttttctgcaataaatagtccattttctgcaaaatatcttgttttttttgatttataattcatactaaaaaattaaggaggcatatttatgatagagaagatggcattaaaactcgtcaatcaaatggagatgcagaagataataagcaaatcaaattgcgaatattatgaatatgcattaataggtatggctgaacatgctataacaattggaactatgttatttttaggaatgttatttagacaattcccgcataccatttgttttattgtatttttccttttattgaggaaacgtacagggggatttcatgcggctaagttttggcaatgttatctgggaacaattattttttatattgcaattatacagattgtacctatactttgtagaaagccgcctgttatgtatggattactattactttcaatccttttaatctgcataatgggaacaataaatcatcctaatatggatatgaataaaagtgaattggatgagtcgaaaaaggcagcaaggctgttgcttttaatggaagtaatgatactcgctgccttagtttatttgaaagctgatattttgtatattggctatatgtcaatagctgtcatcttatgtgcgttcctgatgtgtctggcaagaataataaaacaggaggtaaaggtaaaatgaatggaaaagaaaaaatcaacaaaaaggcattaaaggtagtggaaagaattgcccgtaatgaggttgaaaaagttaggcgtggatggcctccaatttgttctgggattcttcatcagccgaagagaccgaagcggaaggatgattaagaattaatagttaatatagtaataatgacaaatcaaatattatattgaacaagaaacttaagcgtagggaaaaatctttcagaacggtacgacgtgtctgaaaggttttttgtgccgctttctgcaaagaatgtccactttctgcaaggataattgaattttaatcatattttgctattatgagactaggaaaattttaacagtcaacgatatggtggaaatggatttcaaatcattttatcaaggaggtggaatagtatgtcaatgagtatagttggaagcagttatggacaacagggatataatagcattaacgtaaacagtaagcagtataaagctgcagcgaatgaatacttagatgctgttattgctgaagaagctatgatgacacccgaacagaaaatgatgtatgagttgatgggcggacgagaagcacacatgaaaaatgtgatgagcaactttaattcggatggggattttatcggtcccggaggagttgttgttcctggtatgtatcatgggaaagacggtacggaggatcgttcgacttggcagcagataataagtgtttctgacgaagcacgacaaaagatgttcgataatgtgaaaagagagtttattcaagagaatggaatctccaatggcgatacaacaaaaagatcaaagatatttaaagaatatcaattgagtgtaaagaaagaagatcgtgcgaaaggaacatggacactgcaacagtatgagggcaaatatcgttctgccatgtatgcggctgtaaaggcagcaaatcccgactgggagccaggacagccgtttgattccagcatattggatagcgtaacaagggaatcggtggaaaacaatctggtgcaaagtggcaaccagtttgttagaaaatctattgattacagtgtttaatttcatatgcacattaagatgttcgtttcagagtgttgtaacactatctaaaatgtaagcgcatagttttagggcgtacccttaaatgaaatctgacaccccgcgctaggatgccagacatgcgagtatttcactacattttatttacaagttttctgagtcaatttactccacggggcaaattgttccaattcctcgtctgacatttcagcaccaggacgatgctccagaaggaagctcagatatttaagtggatcaagttcattggcttttgccgtttctatcatagaatagattttcatactggcttctgccccggctggtgtatcacagaaaagccagttcttacggccaactaccaatggtcgaatgctgttctcactgagattattactcaggctgcatgcaccatctttcagatagttcatcataaacggacggcaaccattggaatagttgattgccttgatcagcctgtctccggattccggatgcagctgatcaagccatgacaaaaaagcctctatgacaggtttttgatccttcaggcggcgattataaatctgtttgagcgataatcctttttctcgataagatcgttcatactcaaacagcttattacagtataggaatccctggactaccggatgtgtataatccttttcgtggcctttgggtattgcccgcagccaatagcgtcgtatgtgagcccagcaacaacaacgctgtgcctccggcactttgttgtatcctttataaccatcaaccattagatagtatccgggatctgcacctgcaagaaaagcagcggcatgactgccggctctggtcggagtgtaattataaaggatgataggaatcccaccattgtcaccagttcgtaccagccagacataagatttactctgtggtctgcggccttcttcctttaatacctggatcggagtctcatctgccatcagatatctgcgtttcaacagtttgcggtgcagatattcatacattggcagaaagtaattctctgcgcagtagatgatccaactggccatggtcgtacggctgatctttaccccaagatgttcaaagtccttctcctgacggtataagggcatggacatgacatatttataatacatcacatgtgctgcaagaccggacgatgcataactccccgggatcagtgcaggagttccttcgtccttgatgaaccggggatcttccgtttccttgcattgtggacactcataggtagtcgcataataatcaatacgctccagctttggctctgtataacgcagttctgtccggatgagttcgtgtccgataggaaccatcattgttccacaaacatcacacgttttctgttcttccgtaagagtatctacataaacattctctgtcggaagatcagcaaagacctcatcataagcagctttcgatttacgggccttcttgtgtgcttttacctcaatgtattccacctcaaggggcaccggttccggttcatcctccgtctgcaggtggaacagatccaactgtcccgggagctgttcatgccggatctcactggtggagccaaaaagtctggtcttcaggtagtccaactgtgcctgaaggttagcgatcagttgatccttttcgctgtctttggcatcacgttcctgcagcattttctgcagggaacggataagctcgttctgagtgctgattgtattattcagttgtgaaatcgtatccttaagctctaagagctggatatctcttactcctgaaggcattgttttttcgctccttttctatggttcaattataccataaaacaagcgaaaaatcctgaaaaatcaagcatttccggtactttttattgcctttggctgctcgatttcaagacctgacataagccagtcaaactgcctccatgtaatgggttttacctcattacggttgcgcggccaacggtattttcctacattggcatcaagtcgcttatataaaagtacaaatccttcacgttcatgaagaagcacttttattcgatcactacgtctgccacagaagagatagattgcatttggcctggaagggttcatattcagctggtcttttacgacagcgcataatccatcaatggacttgcgcatatctgtataaccacagatcacataaatcccgtctgcgacagtgaagtctcctaacatgtccctgtcacagctttaaggatctgtgacagcagcttcgggtcaacatcatttgaaatttttattgaaacagtcccaagcatgacctcgatggcggggcagggttcttccagcggaagcattgtgctttcgacagttggaatgcccgggttttgatgatcaggtatcacctcaagttttacaacatccggtttaagggctggcttataatcgccgcgtcctgtagcagaggggatatcataacaagctttttttctcagtcttttaacccagttgtaaaaggtgccgggattgatgttatgttctgtacaccattggtagtcactaagaccgctgctgcggcattccatgataagttgatattgttcgtctgctgtgcgtctttgcgttttcatacaagaaacctccatagttataggaaaacgctcgcatttatagtatctagcgccgatactgtagtaaaatgctggcatctatcatctataattatggcaaattttgtgatgattttaaatccaccctgaaactaggcgcttactctaaaatggagctacatagtaatttgtggctccatttttaagaatatataacaattatttgatacaagcgctttagatggcgtaagcgagagttcaatagttatctgaaatagataaataaatctgaaaaagggaggtaattgcatgggtgttgattctatattaggatataatttatctgttcaaacaaaggattttacaaaaagaattacatcaggtgcaacaggtgctaatcaaacacaggggctatcagagtcagaaaaattagaaaattttaaaaaagagatttggaaagaaatagattctatgtcgtggggatcgaatatttcggtacaaataacggatagtgcatttgaaaaaatgatggtggacaaagagtttaaaaacaaaatgatgaacatcatcagagaggatgcccatggctcaaatatgatgtgtggtggaactttaataaacattgatgaaaatagatataaaggttattcctatatgcagagtcatacaaaagaggcagggagagcgtttgaggcgcattccaaagataaagacagtttttattcaaaaaagtgtaaaaaagatgaattaaatgaacattgggagaaagagagattgaaaaaacgccaatatcaggaaaaggctgacgatgagtatatggagagcttacgtctgaaagagatatttcaacacaaagaagatgttgcaaaattatacgaagaaaaaacagtcaaaaagtaattggaagatatgtaattaccgtgtttaggtaaattatataaatacatttggaaaattcagagtgtaggatatgaatttaaacataatacgaggtaatagagatggatatattaaatactatcaatacggtaaaagtgtcgggcagttctggcagtagtgttaaaaaaatttctgaaaagagcaagtggcaattaacggattcgttgaaagagaaaattgttgaactggctaagaaggacgcgaaaaacaatgtatatatgggaaatgagtttatgaacttgcggaaagcagaggttgctaaagtggcaccaaatcgggcggcactgataggaaagttcaaccaatcaatgagttctggaaatatgggggatatgaaagaaatacaagaggcagacaaaagatggctgtgtattttatttgggataccatatggggttgaatatcaaggaaagggaactggttctgcgctccatatatataatgagggaggggaagaagttcttacatacactcaaggagtagggtggcatgagaaagagacaaaagcagagacagatgtacattcaacgttaaaatcagtatattatgaggcataccatgatgcaagaaaggcactgaacactggaacaaatgtggaaatcacaaatgaaaatattgtggtgcaaagtaattttgatatgaaagcataaagtatgtaattcagcaaatgtatataaggcgaatttgacagataggaggaatgcgattatggtaaagtcaatgaagaaaataaagaaaataaagaaaataatagcggttgctttggtattcacaatgttgtttgcttcacaggtaacagcatttgcagcaagtccacaaacgaagccggcaaataaagatatgtcgattgcattgatgccgggagttacaggaaattccaatacagttacttttaattttagcagtctgccagataatgcgattgtaaaagaagttaagattgattgttccaatgcatctgtaatcggtggaaaaggagcaatattggcacagagccttatcattaccagtccaagtggagaaattcatactgttggttggggtaaaggtaatgtgactactactaatttattcattgcggaaaaagctgctggaacatggtccgtgtatatgacaggaaccaatattgcatctccaagtcttggttctgcatttatcgggggtacaaaatattcacgacctaaaatgacgataacatatatagaagaataaaattgcatattccctataaagacatttgtatgaataacattaaataaaatcagtctttgaactataacagttcggggctgattttttattcggcttttatccgtttcttgaaatgttttgttgccgttttctgcaaaaataggttattttctgtaaagattattgaatataaaaagatgtttggtatcattaagcagtatgcttgttaaaagtagaaatattaagtattgagtatatgctatcaggaataataccgaaaggtttgatgttatggtataaagctgcaaattccgcttcatcggatcaccgattccgctagcaacggatcagtgtttccggtcgtaacggaacacttttccacttcgtcggatcacgcattcttataaagtgttatagttttttcgtagtcattattttagattacgaaaggaggcatttttatgcaggactacaacactattattggtgctattcagatgcgtctgaataagtgcccaaccagatctgttatggatcgttttcgaatcggatcaagcactctggtcctatgtcaagatttagtacaagttaaaatgagaaacttttcccattttaacccgccagaagctcagcctcagtgtgtgttctttcatacaatcgttcgaattcatttggtgacatatagttacaatggctatgaattcgtttcgtattgtagaaagcttccagatattcaaaaatcaactggtatgcctgcttatagtcgcgaattttaaagcgattgagccattcacgtttgataatagaatgaaaggattcaatgcatgcattatcccacggaaaagctttcttcgaataactgcgctgcatattttcggttgcttttttatattcctttgcaacatattggctgccacgatccgaatggataattaatggttgatcaatatttcggcgagctttggctttgtttatagtatcaatcacgcaggatacttccagtgtttctgaaagtgtccaggctatgatttttctggaaaataaatccataatactggtcagatagacaaatccgtctattgtccagatgtaggtgatatccgaacaccagacagcattcgggcggtcaggattaaactgttcatcaaggatattttgtaattctgtgctgaaatcagaatcttttgtggtgatggtccatggtttgctccactgagcacggattcccatttggcgcatatatgtaccaacggttctttccgaaatgacttcaccggtttttcgcagttctacagtgattttcggagcaccgtagttctgcttggaatcatcataaatatcctgtatttttgcttttacagctttacgacgtttttctgtatcagaaggtacgtggtggagccatgcaagatatcctgagcgagagacacctaaaaatttcaacattccggagacggaaacccggcgtccagcctttttggcagcttccgtcttctcagacacttcaagataaatggcttccgtcattttcccagaatgttgattgctttttttaacacatcaagtgcatcttttgcatcacgtaattcacgtctgagacgggcaatttccttctgctcatcagatgcataattaccagaaccacgaacaggaatatcacctgattcccggaagtctttcagccattttgttaatgtgctgtatccgatgccaagattttctgcacatccacgtactccgagatctttgtgatcctgatagtactggactgcatcaagtttaaattgtttgtcatgttgctttgccatatgagatcctccttcagcatgcctctattgtatcatgcttatgtgtatttggaatttctcattttggcttgtactatttatattctagcaccactcttaacttgatcatgagtcgatataaggctcttgagctcaccattgacgagcttgaaactccttctactgctgtcagaaggaacttttacaataacactgatgtatgaaagagtaaatatctactgtgcaggactaaattctaccgccctgtagggcagtggaatttaaaatttcattttagggggagtgacgaaattagtagaatatgatgatttcttgggggatgtgtgatataattttaaagaaaatagtgatatctacaagaagtgttttgagcctatagatgaacaagagagttgtacggatgacagtataaaagagataattaggaaatattagaaaggtatggatatggagtatctggaaatacattcagaaattttcgatgatatagtggaagacatcaaacaaagaaatctttcaaggaataatatgcccaaaattattgtggggacaggactttctgtgatttatggtgttccggggatgaaggaattagcagagcacttggcaaaagaaattgcacagtcaagtgatgaacatttgaaagaaatttggaagaatcactgtgatgaaatagaagcaaatggcttagaggcaggtttggctaatcttgcacaaaatgaaaatgagttagtagatgcgattaagccgataacagcaaagtttattttggagagtgaggaaaaacttcacagaacgatttatgaaaaagatactggtttttgcaggctgctgaaatatttgagtggtacggttagtgtcgataaaaagataattgatattatgacaccaaactatgaccggattatagagattatatgtgacaagttggggataggcgttatcacaggattttacgggagcctgtatggaaaattcagtagaaatctgttaaaacagccaacagaagtatataattgtaagaattattcatggatcaggctttttaaacctcatggctccataaattggattagtgagaatggaaaagaatacctaacaaatgattatgaaattctaaaagaaaaagcagaatatattgagattgtaacacctggaagttcaaagtataaggtaggaatgacaaacaatacgtttcgatgtatgagagaagaatttaatgagctgttgaatccgagggataattattcgcttttaatatatggatatggatttaatgatgatcattttgatactgcactatttgacagttttcagaagaatgtccttattttatcaagggatgttaagccagatataatcaataaggcactggagaaaaagaacattactgtattttatcatgaggatgacagagaatatatgatttataagtcgaaaaaatacacaatagatatgccggtgtgggatattaatcaatttgctgatttgtttataggataaaaggggtgattttatggcgggaaatattaatgattgcttggcagacacaaattgcataggtatggtggaaaatgtagacacccgaaaagttgtggtgggggttgaaaatgaaggagtactaaatacattaaaaatcaacgatattgttgttttgggtggaagtaattctgatgagaagctgattggaattttgactaaggtgacaaagaagaaagttgaatttgatgaaacagagcagacagaagacctattgtattcaaataactgctgtgtcgttaatttggtgggaagtttttacaataaatatggtgctggaagtgagaataaattcaaaagagcaattaatacatatcctgaaataaatagtaaagtatatcaggcgaatgaagccgcaatgcagatgataatgaatgctgtgagtggcaaggcggcagagagtaaaagtttagaaatcggacattttgccagcaataaggatgtggcagcaatattagatggcaaccgtttctttcaacgacatgcatgtattgttggtagtacaggaagtggaaaatcctatacagttgccagtgtattggaaaaagccaatcaattaccatatgccaatatggtcgttttcgatttgcatggggaatataatgagttatcttatgcagatcagatcaagatttgtgatgaaccaggtggtttacacattccattatggtttttcaattatgaggaaattcattcattgtttgtagaatcatcagaagggacatcaactaatcaaagagcggcggtaatcaattatattttgcagaagaaaaagaaatatatcaaaaataacatgagtgctgtttcagaagaaatagtcactgctgatacaccggttcctttttcagcaaaggaactaatagaatatctggagaatcagaatattttagaagtcgatactggagaagtctataaatcaggcgatagtaagggacaggcaaagacgaagaaagggcagtactatgacaaattgaccaacttgattacccgtctgagaacaaagatggatgatagaaagtatggatttgtatttaatgaagaggatacaacgcaggcggattatctaaatcaatttgctgcaaggattatggggaacgataaatatcgaattaaggttatagatttatcagaggttccatccgatatgttagcaattatcattggtattgtcactcgtataatatatgatatacagttttggatgactccggcaaaagatgaggtacgtcatccgttggtgctggtgtgtgatgaggctcatatttatatgtctaatgacatgtcaaaaatgaaagcggttgagaagaaatctcttgagatttttgagaagattgccaaagaaggaagaaagtatgggattggattgcttatagtatctcaaagaccggcagaattaaatacaacaattatgtcccagtgtaataatatcgttagtctaaagataactaatgatagggacaaatcggcagtggcagcaatgctgacagattcattagtgggaattgtagaaatgcttcccaacctggatgttggtgaatgtgttgttgttggcgatgcaattatgctaccatctaaaattattctggataagccaaaagaaaagcctaagagtgcaactatagacttttgggataggtggtacgacggaaagcagactgtttttgatattgataaagcaaccttgaatttaataaagcagtcgagaggataaggaactaataaaaagtgatagataatccggtattatctaccataaaaattggaaatggagggtactatgaatattgtgttgggagttcatgtgaaacatgacagaagtgcatgtatcattattgacggaaaggttgttgttaatatagcgaatgaaagattagaccgagtgaagtactctgactctcctgaaatcccctatacagctgttgatgctgttttgaaacattgcaatattgatatttcacaggtttcatgcattggtatgtccggcgcaggaatagaaagtgaaaaggtaaaacagttctataaggatgactttttcgctcactatagatgtcgcgaaattccttttttctttctgtcacatcattgggcacacgcatattcttccttttgttcgtccactttttccgaaagcctgatatttgttgcggatggtggaggtgactatatcggggataagcaagaagctgaaactttgtattacggtagtcacggaaaaatacaaccactcgccgcacggacacaggatatggttgtgcgcaaaatggaaaatccagtaaatactatatatccttttatgccggattatgtacgcaaccatcaaattagtatagcacgaaaatatgcgcaaattacgcatttgactggctttgcacatggagaatgtggtaaaacgatgggacttgcttcgtatggaaaatcttattttgattactcccaattagattttcgtgatttagattttgatttaaagtataaggatatgttagaagaaatttacgcattgcatatcatgtcaggaaagtctcatagagattttatcttgaaagaacgtgcgaatatatctgccacagttcaagagtttacagaatgtgcaataatttcgctgttgaagaactatcagactcgatactcatgtgaaaacttgtgtcttgcaggtggattatttttaaactgcctattaaaccataaaatactttgtgaatgtaattttaaaaatgtttttattattccatcggctggagacgatggtcaagctcttggcagtgcatactatgcttacatggaaatgttcggaacacaatccgattttcacattaatttaccctacatcggtttagattataccgagcaagaaattgaagatgcaatccgattgaaaaatctttcctacaaaaagtatgcagatggtgatttggcaaagataacagcagaatatatatctcaaaacaagattgttggcatgcacagaggaagaacggagttaggaccgcgagctctatgtcatagaagtatcttggcaaatccaacccatccatacatgaaagacatcttaaatcgtcgcgttaaacatcgtgaagaattccgtccttttgcacctacggttgcgaaggaggatcagttcaaatattttgcattacgggcttcctcagactatatgttacttgcgccagttgttagagaagaatatcgcgaaaagttgtcagccgtgacacatgtagataatactgctcgcgttcaggcggtatcaaaaaagagcgacccctttatacatcagctattgcttgaactgaaaaaagttataggggtatccgtggtactaaatacgtcgttcaatgttgctggagagcctattgtcgaatctccgcaagatgcgttaaacacttttttgaaaactaacattgacgttctagtaataggaaactgcgtagtaactaagccttagaggataagcagatagcgtgtttgcgtatcccatagaagattggatggggtgttttgtgcaaataatatctctctttttctcgcctttgcatattgctgtactagaaaggtattaaccgggttatcggatagattttggtttggatacgcagagtattcttgccccgcaaacgtaacaagggacatcgtttgatagaactgtgattcaaatttacgttcttgtaaatagtatccgatattgcttaacgccaaaatattcccttcgcatgcatcacgattccctatatatagaagcccttgctttttcagtatatcaaatactgtgaaaaaaattttataaatatgttgagagtcgaaccccatccgtattccaataattgcttgcaagttatataaacgccacaaatatcctacaattccataagatgtgctgagattaatagctctatctacatattctttcgctagaagggttgccttttcttcgcttttcaatagattgcatatcgcaagcaagaaaaagcagtgaatttgagcgcgatgcagattgtttgcttcaatatcttgtaacattgaattaagctttaaaatcagcttgtcctgatgaacagtagaattacttaatatttctaatgcacaaacatctagagaattatctgtttcaatccttttggatggcatcagtgcagttgcttctatggactttcgcaagctttcgctagaaagatccatattaggatatagagttattttaaattttgttctatatgccaaggctcttaacctattgtcatccaatttgtcagctaaggttattgacagagtattatatgtcttagataagtctattaaattgaatgcccgataaactgctgccaatctatcatatagatcgaacaaagtttcatcagataatatttctttattgcacaaccaatctgcttggatttcctttagtaagatttctccgtctggatacaagcctgcgttcattaaggcatgagcttttaattccataatggaaagacaaaatggtctatcatctaccatcttatattgtttaagtttttttaacacaatatcacattcgtctactgctttaatcggggcaaaatgatgaagagtgatatatactcgcatcagcaatgccttttttgctagaggtaaatttttgcgaacatgtcgaagcaactcaaacatatcctctaaatatttataataatttaagtttacattgacatttgaaatattatccactgcgattagccatgtttcaatcgtgtgtagatattctcttgccttcttgtaatctttgctatataaatagagtcttccggtttgaaacatacctaaaacatgatcaatgtttggtatggatacaatctcttttgcgagaaaagttcttattgcttttttacctttcaactgttcgctcacgtatagaaataaactttcgtgaacaaaagcaatcgtttcattttcttcatattttaataggcgccgtcgcatcaattcattcaattgatcagatgaatcctcaaaaaacatgttaaataacgcaaggttcattttaccattgcataacgcaattttgtacaatagattcaaacaggtttcgccatctttctctttttgtagatgagaaagccgctgatagtagatatctgcaatctgtgttggcataaaacgttttacatggaatttgttaatatctataatgcctaccgtattcctattttgaatctttaccaaactacaatccaacagatactctacatattgaacaataaaaagtgggtttttcgcacttagattaaataaacggtctaatgcatatggaggtataccgtcaatcaacaccctaattaaatttttagcttcatcatcagtaagcggctctacattgaagcacgactctggcaaattttcatttgcccattgaacaaacgacaagtaattgatgttcccgatggtaaaatcggttcttccactaatcagcaacgtgattgaagataggttagactttagcctttgtatttcgcaaaggaagctatcgtctgcattgtgaaaatcatctaaaaatattaccgcttgattcccaaacggagtcctacagttttctatcatagaaacaaaatccacatactgcccctcttgtatgtatccatgctcaagcagaaatctttcaatttctttttggggagtatgaccctgttgaagtttacattcataaagatcaaatagcgtgccctgcaatcttgagaacaattcttgcacaagtctcgttttaccaattccggcatccccccaaaagcagacaatgcttggtgacatggtcgactttagcctttcctcaaggtcattaacaatttggattcttgattctccaaaaaatggaggttcaaaaatctgtgtgccatttattccattaatcataacaactgattctgtgccattaatttgaatgtgaaataggagttctgggatgccatcaaagtgtttttgttctaccgttacttttttgacggttgcaccactaggtgcaatcacaaaggatatattgtcttcggaagtattccaatccacatctgtcctaagctgtaaaacacaatgcttttcattattggagtaatttcgaaaaagcatatataaatcatatcgattagttaattgtgaaactacagtatcaacctgatactcatagtaaaaatccgcatgatctgataaactatacggattattgagtgcatgttgcaacttttgatcttcgagacttaaaaggtacgtgcccaataaatacccatctattaatcggaatgatatgttgcttctttccagcgacttagtcaaataccagtatgtttgcggcaaaatttcactattagttaccagaacataataatcatacttctcggtgtcttgaaattgcattctggaactactagaagaaattttatcataccttaaaatgctattatctgtacttttgcactcaaaacatatttggattcctttaccgttaaatgaagtaaaactctgacctaaaatattcacagtgttaattttggtggaaacaataacatcctttccaccatctgctacgcgccgtgtctggaatacttgtacttgtggatgtagctgacgcaattgtgccataataatttttgcaacaaaatcttcaaagttttgtcccaaatttgcttccatctgccatgttaaattgggagacttcccactagaatatcgcctcatacatttccctctcctatcacttcttatggtagataatttagaattaccccttatttctgtcaaattcaacagataataccggattatcattcaaaaagacaacccatactcggagttgtctttttaaaattatatttcaaaattctttcttggatgttttgtcgtgagaatatccctttgctttgacatggcaacatgggtatagatttctgtgatgtttatagaactatgccctaacatttcctgaatataacggatgtctacgtcagcctccaagagacttgtagcaaaagtatggcggaacatatgcggtgtaatatgcaattcaatgccagcaagagaggtatatttcttaatcatgcgccgcacagattgatcggataatgcagttccgtttggatttgcaaaaaagtgattgcacttttgcatttcagttaggaaagtgtttttgtatgtatttagaatttttgtcacatcatcatttccgatttgaataatccgttctttggctccttttccatatatcaaaacagttctgtcatacaaattcacatcactaatttttaaagaacatagttcggaaattctcatccctgtagcaaaaagtaattctataacggctacatctcttagtgcacaatccctttggtaagtggtttttgcgttgtgatattggttgtatatggcagatagaaatgtctcaacagtatgcaagggaatcgtttttggcagaatagttggttctctaaaacgcagttgtattttattaaacggatttatagtaataatttccttgtacccaagataatgaaaaagtgcttttaacgatgcaatttttctcttgaccgtttttggtttgtacttttgatggagtgttgcaacatagttttctaacatagccgaggtaatgccggatgcattttgggtaatattctgttctgaaaattgccttaaatcaattcggtatgcgtttattgttttactgtcaagccttttttgactcttgcaatactctaagtagttatcaataagtatctgtaaatcgttcatagtggaatctcctttgtttttatcttatctatcaatgatatatcgtacatgaaatggacttcacataaaattaccagattacaccgtcttactctccaatctgtgtcgtaaaaaaatcaggtgttttgccctatcatagttataggctcacatgagtcttgaactttgaaaaactaaataggacacgcatacacccgattttattttcgcctttttatctgcctatgcttatgtagcgataaaagggtggcagaatcccatttcgtgcgatgacatacctgcaatggataacattgttgcctgtgaaggtaaaaaacgtaagtttttaagagcagaggattgtgcctactggcatggcaaccagagataatgagatagaacggcaccggaatttcagcgaaaagcatttttcgggagtggctgcctgcggattccgtcatacatgaacgaagttcatgttatgggctatgacagaggcgcagtgtgggatgaagccgtcccagtgtatgttacccggttcggggacaagcgagagccagggatttgtcacaaaaagtaaagagtgcggtagcaacaagaatgaagcggggggagtatataggaccgtttgaaaggctgcacgagagactggtatcctgacggcaaaaagggcggctggaacacaagtatggttgcaaagattatccgtgacgaaagatatgcaggtcacatggtttcgcataagaaagtgtatgaatcctttgagtcaaaacatcaggttgcggttgacgaatctgattggattatagtcaggaacacacatgagggcactgtgacacatgaggaatttgacaaggcaaacgcaaacatgcggacagtacaacgtggaaagaaagataatccgtcgaataaaaggaattactctgttattatctgtccccactgtggtctgacactcagaccggggaacaaaaaagatatttacatgtactgtcctactggaagaacccataatgacagtccgtgtaaaaatgtacggataagaaaggaagttgtggaaaatacgcttgtcagactggtaagaaatcaggcagaaatgcttgtgacagccgaaaatattctgaagcagaaaaagaaagataggttcgggcaggatcagccggatatgataattaaaagattaaaggctgaaacgaaaaagcttgagggcagtaaaatagcagactatgaaagttacaaagccgggaaaataacaagggaagcatttgctgggaagaaggcactaacagaggcaagaaaacgggagatactggcatctattgatgaaaatcagttgaatgtcacatggaaacatcaagatatttatgagaaaattttttccgttctgtaaacagtgtgtggtataataagggtgtccattttgcggacacccggaaaggacaagaggatgatatttattacaggtgacacacatgggaattttgaacgcattgaagtattttgcaggcgttttcagacttcgcatgacgatatacttattattcggtgtactagagtctcttccaatcacgatatttgctattcatggaaaccatgaacagcgtccttatatgatagacagctataaagaaaagctgtggcatggtggaacagtgttttatgaagaagaatatcccagtattctgtttgcaaaagacggagagatatttgatctgaaaggaaagcagacggttgtgatgggtgaggcgtacagcattgataaggcaatccgcattgcatacggatggggctggtgggaggacgagcagccctcggatgaaatcaagaaatatgttgaacagcagcttgaaaaatctggttggcaggtggatgtggtgctaagccatacaacaccattgaaatatgaaccagtcgaagttttatggctggtgtggatcagaatagtgttgacaagtcaacagaggtctggctagatgggattgaggataggatggaatataagaagtggtactgtggacattatcatacagaaaagaagattgataaacagaaaatcatgtttgaaaacttcgatgagttctgcgcaggtgtgaactgataatcgtttcaatgcttatcaaataggcggttgcagacatcagcaaaaaaatgtaatttttttgtcccatacttgacatgagctgatggggatggcagtctatgattggcaacagattaaacatgtcaggcgtcaaatttcttttctaaaccagcataagaccaatatgctgataaccagtgacagaaaatcgggatgtatcgctgaacttacagatgaattaaatattctgattgagcagacggcagctttaagaaaaaagattgcagaaaatgaaagtcatctgaaagatacaataatcaatctttcccatgatatacgcacacctttgacttctatggacggatattttcagctcctgttaaaaagcagtgattccgaggaacgacaacaatatgcctctgttattgctgaccgtctttcttcattgaaagaaatgcttgacgaactatttacctacgccaaactcacaaacagggcgtatgaagtagagctatatccgtgtgctgtgaatgaaatcctattgagtgtactttttagcttctataaagatattaagcaacgcggcatggaaccgctcattgctgttccagaacagaatatattgattcagggaaatgaacctgcacttcatcgcattttccagaatataataaaaaattgtatggaacacggaaacaatcatctttcggttcgccttacaaccgatacagataccgtacagatttgctttgaaaatggctattatatacaggaaccgatggatgccagtaaggtgtttgaccgcttttataaggcagacaaagcaagaagcaaaaacgcaatagggttggggttgtcaatcgcaaaagagttggtagaacgcctgaatggttctataacgggagaggtgatggatggtatttttaccatttttattatctttcagagcgtaaaaatttattagacagaagttttggtaatgtttacgcttttaaagacagcaagttttatccattgaaaaaaccaatccggtgtgattccattatgtacgaaagtcgcaaaaagagtaataacaggaacgctgatttttggaagtgtttgtaatcaagaagaaaatcaggcagaaaaccatgcaaaagaccatcagagcagtaaaaataatactttgaaattttgtttttggcataaaaataactccttttcgtgggaaacaaaaaacgacaataaatagcagtggatggctaccggacaaaagccacaccgatatttattgtcgttatttattaaattgcaacagaaagtattatatcataaaattaaagggaatgtaagaggaaagaaatttaggaacgaggtgcctgacaccagttccgtgggagcgagatatcatgaaacttgcaatgtatcagatggcgaatgcgggaagtgttaaggaaaatctgaataaaagtttgaatgcgattgcggaagcagcaaaaaatcatgcagatatgattttatttccggaggttcagctgacagaattttttccacaatttgaggggcaggataaatcagcctatcaagtggctttggattctcaaatagtaaaagcatttcaggaggcctgtaaaaaacatcagattatggctgtccctaatttgtatttaaagccggaggaaggaaaggacaatcatagagcgtatgatgccagtcttttgatggataaagatggattaattgttggaatacagaagatggttcatgtcgcgcaggcagaacttttttatgagcaggattattatttgccgtctgatgatggatttcatgtatgggatacgccgtttggaaaaattggcattgtggtatgttttgatcggtattatccggaaagtatccatacagaagcgttgatgggggcggattgcattcttgtcccgacagtgaatacaaaaaaagaaccgatggaactgtttgagcaggaaattggatattgatttgcagcaggcacgcagtattcgcgcaaagaaaccatatatgtctttaagacgtagagagttttacgtttagaaaatctacgcatgaataaagaatcacgtgattagtccgatataatagacataaggggcatgaagggcacatttcacggaggggatactatgaaagcaggagaggcaaggggaatctacagttctgttctaaaaacatacaatgagcagaaattcaaattgtcaaagcagcggaatgagttaaaggaacggatggaaaatacaccggatggcaaaacacggtatgctgatgaggcagccacgctggaactgaaatataatgcggttgcagagaaatacgatgagtatcagagctatgtaagtcagcttatggagcagtggaacagcaagttcaacagtgttgtggcaaagcagcaagtggaagtggcaaaagattatggggaagaaatgggaaaaatcatgactgttgccagacgcatcatgcatggggaccaggtgcctatgcaggatgagaaaaagctgatggaatttgataaggatctatacatcatggcgaaaaatgccggaatgatggcacaattaaaagaacgtaaaaaatatgattcgctttgggaggacgaggaaaagaaagagtatgaagatccgatggaggcagccgatgcagaggaagcatttgcggatggaccggaagtggtgtcagtggaatcggtcatggaggcagcgattggagagaaggagtcagaatagaggatggaaaaatgtgtaaggacgattacccaccagttgtacggatgaacagcttgaaatgtttaaaagtgatttcaaggttgttgcacgttttttcgttaacaaaagaaggaaccctgactatgttgcggatgacccaacagaaatccagcacgtagatgaagtcttaaagcttttatctgttatgacaggggaccgggactatgaaaaagttatatgcaatgaaatgaaaggtcaggtgaagaacatgtgtgatgttgctgaaagattaaaaaatatgggacggcaagaggaacgtatcaatgcagtcaagtttgcaatttcccttggtgcatctgaggagaaaatccttaagcagtattccaaggaggaatacgaaaaagcgttggctcttatgaaatcctgattgctgaaagcaaaattgctgttttgaaaacatatagcagcataagagcttgggttttattctgttaaaacttttaaattcctttatcaatccgtattctaatggagaaaatgtcaggtgaagagcatgtgtgatgttgctgaaagattaaaaaatatcgggcggcaggaaggatttcaggcaggtcgttcagaaggtcgttcagaggaacgtatcaatgcagtcaagtttgcaatttcccttggggcatctgaggaaaagatccttacgcagtattccaaggaggaatacgaaaaagcgctggctcttatgaaagcctgattgtggaaagcagaatagtttttcaaatcaagcagcatagatgctgaaacggtagcgcttgcatgatcaattaaataagcactagataaaagagtcatccatctggatggctcttttatcgatcctgatatctgcgcggatttcgacaaacagctcttatggtgaatttaaagaaattaaaaaatttttatactgcatggttttctttttctgcttgacaaataccatttgattgttcctatacttttttttgaaaattctggtatttcttttctcctatttttattgccattcgtaaaaaaagaagttatagtggtatcagaacaaagaaaacaggtgtttccaaaaggaaaccagagtataaagtggaggaaatgtatatgaaaaacaaatggttaaaaaacagcaacagacagcacctgagatattccatgcgtcaggcatccggaattgcacttgcccttgtaatgggaatttccgtagcagctgcaggacagacccagagtgtaaaggcggccgttgatacacagactgcagataccggtgtgacagcaacgacagataccgcaaatcagactacagaaacaactactatcgggaagaaccagatcagcatcaaggattttgccagccaggtgcagaaagtaacagggaaagacgtattaaagaatgccggcataaaaaataccgctgccgctactacaaacgagatagcggcatatctcctgaatgaagctgattccgcggttaatggaggggaaaactcctataactacgatctgtatggctatgtgaaatattttaaccgtatcagtgatatcaagaaggctgatgacaaatataaggaatccctgtacaaatgcttcaccaagggcattatggtaggaaagagtaacggaacatattccagcacccggaaatttctgccaaagacaaagatcaccaaggacgaagccaagaagatgataaatcgtctgaaaaacaaaggaaaaagattcaaactttcctacgatggacaggtgttaagaatcattaacctgccaaagaactataaggattacccatatattcttgcaagttttccaaattcttattatgagaagaaaatgaatatatcaaaacagcggacaaaggaggataagactccagcgcagacggcaaagattttaagtgatgaagataaggatatgatctgtgcgaagattaaaaagaacgtagaattaaggcttaacattaattataaaaaaaccttcacttctaagtggaaaagcgatttaatgggtacttattttgataacaacaaacaaaaatctgttaatgcatatatcaaagctgcaaaaggaagaaaaattgttatgaccagtggtgatgttattgtcgatccttcttctttgtggttatgccggaatggagtagtgtatggtcgagtttatgtgaaatttcgggttaagaatggaaatattccttctgctaaaagtgaactgcaaaatgaagtaatttatggaaattatacagctgttaaaaacctttcttctaaaaaaacaatcacatatgcaaatgaaattggatgcgatatctcatatacagggaaaaaaataacttcatgtggagtcagtgtctatttcgacggaatagacaattattattaaaaaagggggctgtaaaataagtccctaatataagaaacgccaattccggcaaatgtcggttttggcgtttctttgtattaacttttctatttctaagcaagtctgcatctttgggtataaaaaatggtgcatttaataaagctcggctaatcacgcccgcttaagttttatgcaactttcgtctgtcgttgctttttgttgtgatatttataaagattgaatccacatgaaatcagtgtaagctcgagaattacatttttctcgcctcttcgcaataatcttttatacgctttatcccactttaatacaccaaaagttccctccgattgaatacttcggttcattctcaagagagcaccatgtatggattcaagattttgcagcacttcctgatggatagcagttaattcctgattcattcggatcgttcggtttttgtgtgttctcggacaacattcctgtttatgctgacacccttcacaagattcacattcgtataattcttccgttcttccatatttattatatttcacatgctgtgttctcttgaagaggaattttcgaccgtttggacataagagatttccatctgcatcttttgcaaagtttacagcacgatacggattctcatgatactttttgtccgtcgtttcttttttgtacatggtaaatttcatgtatttttccatgccgtgttcttcacaataaagataattattgtaagaaccgtatccggcatcagcaaccggatatttcggatagtgaccatatgtgcgattgaatttttccatcaaaggaacaaagcattccatatcggatgcatatggttttacgtcgattacagctatgtattcatcacagatggctgcctgtaggttgtatgccggaagtagctgatcgtttcccatgtaatcacgctttaaacgcatgaaagttgcatcatgatctgttttggaataactgtttctttcttctccacaggtctcgatatgatatgcataggatttcaaacgttccagatattcatgcaattcttcgtattgtttttgtcgaatgctttttctatgaccacgtccggaaacgaaagaagtttcatccagtccggttgtttctttgtacatcgtaagtaattcagagacatagtcaaccgcgtacgcttcacgcttttcaaattttattccgagatatccaagtacttcccgattcatagcatcaatcaagagtgaaatcttgtcaaagactttctgccggtttttcacacacgattttttccatacccaggtatatcgattggcatttgcctcaatttttgtcccgtcaatgtatgtatgctgcagatccacgtgatctttggcaaaaatatatgaattaatgtcttcaaatatctgctcgatagaatcggttagttcgtttcggattaagtttccaaatgtagcaaaagaaggcgttttcatgccatcaagaagatacatgtaacgaatgtcattacggcagagcttttctatttctcgtaaggagcagatgccattttccataaaggcaaaaagtattactttaaggagtttttgagcatcacatcttgggcgacctgttttatagcctttctctacaaaatatctggataggtcaatgtgatccataacctcacaaaaagtgtataccggatcggaaatatcgatcaatttttcgatttctaatggtaatttcagctgacgcatagtataattaccattggtattgttatttagtagcataattaattataccaaaaaatcgctcagacctcacggtctgggcgatttttctgtcaggggagtttttttacagccccttttttgccatatttcaggataggggaaatggaattatattagacaatctggtgaaattaggttattataaataataagggagttaccctaaaacagaagtgttatagaaattattattaaatggaggtttaacgtcttcatggataaactttatatgatcttattatgcctgatgatagtaccaattcttatttgtatcaaatattccagaaaaataaaaagtgatgtggcatcttccattgtgaaatgcctcatttttgcaattgttacgatccttagcaatggtttgtctgctttttcaggaaatgaaacattttcttatataatggaagcactttatcggttttcctttgatctgatgctgatatatgtattgcagtattcccagcagtatacgcgtgtttttcacgaggtttcaccgtttaaaaaggggtgtttcataattgcatatctggatggaattttactgtttttaaatataatttttcataacgtatttacgatagaaaccgtgcgattcccgaattttgatatgtatcatgtagccgacaaatccattattttttactttcactatgtgtttgcatatggtctggtattttgtattattgcatcgtttataatcaaaattatacagataccggatttttaccgtaagaaatatttgccgatacttgtgttaatgtgtgtgatcacggtttcaaaatttatatgtggaattttagaatttccgattgatgtgtcacttcctttttttgtatgcgcagcaatactgatctgttacctgacactgtaccgttctccgcgtgaacttgtagataaaacactgtccatcgttgtaaatgaaatgaataacgctgtgatatgttttgatataaataacgaatgtgtgtatgccaatgagcgtgcattgaaaatatttaacagttcactggattccctttccgggatctcggaggatgtacagggctggataaaagaacatgacaccaacaattcggcctcccttgaatggagtggtcaaaccattattgacaacaaaacgtattatttcgatatcgaatacagaaaactgtttgataaaaagaatgaatatataggttttttcctgaatctgattgataatacggagaaacatattgcgtttgagaaagaaaaataccttgcaacacatgatacgcttaccggattgtataataagaattattttgcccataaaacatcggaaattttaaatgagaatccggataaagagtggctgctgatctgttccaatatcaaagattttaaactggtcaacgatctctttggtcttgaaaaaggaaacgaagtccttaaaatggaagcagatcttcttaaagcacaatgtggggaagggagcgtctatggacgcaccggtggtgataaattttcaatatgcatcccaaaagaagaatttaaagagcaggattttatggatgcgatacagtccatggggcaagcatttaacaatgacctgtatcatcttcatatttatgtcggtgtttatgaaatcacagaccggaatgaagaagtatccattatgtgtgataaagccaatcttgcaataaagacactgggtgaaaactatgataaatcaattgcatactataacgacacgatatttcatgataccgttgccgaaaagcagctggtgggggattttgataaagcacttgccgaaaaacagttctgcatgtatttacagccacaggtgacatcggaaggaaaattactgggggcagaggctctcgtccgatggcagcatccgaaacgcggtctgatttttccgggggattttattgaagtttttgaaaaaacaggtctgatttaccggcttgaccggtttgtgtgggaacttgccgtacaaaaacttgcacaatggcagaaagccgggcgggatgatctgtatatatccgtaaatatttcgaccaaggacttttactatatggatgtatatgaaacaattaccagtcttgttgaaacctataaaatcattccttccacactgaaactggaaattacggaaaccgcaattatgaccggaaccgcaggggaacttgaaatgattgaacggttcagaaaatccggctttcaggtggaaatagatgatttcggaagcggctattcttcatttaatacgctaaaggatatggacgtggatgtgctgaaaatagatatgggatttttaaggacaacccggccggaacgcttagagagaagtatgtccattataaatacgatcatttcactcaccaaaacacttggtctttccgttatcacggagggcgttgaaacaaaggaacaaattgataagcttacccagatgggatgcggaatttatcaggggtattatttttcaaagccgattccggtaggtcagtttgaagatacctatttgtaaatttatccggaataaaggtattgccaacatattcagtcagatgggacttatataactaaattgaaagataagaaatatttgacgaggcaattcacagagaaattgatggaacattaaaacgtctgggaaccgattatctggacttgtatatcattcaccggtttgattatgagactccgatcgaggagacgatggaagccttaaacgatctggtaaaggcaggaaaggtacgggcattcggtgcttctgcgatgtacggttatcagttttataatatgcagcttgtggcaaaagagcacggctgcctgggctcttccggtgggaatacaactatattgtgtgtgagtaaaacggtatgggggatcgggactcggcaatataattgtttttttaagcgtaatccgttatactagatgcatagtatagcggattattttttggaggtacttatgggaagatttttgaatccagataacggggctttttcagaggcagtcaattcagaaatttatattgataaaacccgtttgctggaatacaccaaccaggtgataaataccacatcaaaatttatctgtaacagccgtccgagacgttttggaaagtccatgactgcagacatgctttctgcttattacagcaggggatgtgattccaaagagctctttaaaaattatgagataagtacagtttcatcatatgaaaagaatcttaataaatatgatgtgatccattttgatgtacagtggtgcatgatggatgccaaagatacagatcatgttgtagattatatcaatgagggaattttacaggaactgagggaagcatatggacagatcattccggatgcggtcaggactgcttatggggcaatgtcctatatcaaagcggctacgggcaataaatttgttgtcatcgttgatgagtgggatgttttgattcgagatgaggcacagaatcatacattgcaggaggcatatattgattttctcagagggatgtttaaaggcacagaaccttccagatacattgcgttagcatatttgacgggaattttaccgattaagaaattaaaaacgcagtcagcgctcaacaattttgaagagtttaccatgctcgatgcaggacggatggctccttacgtcgggtttacagaagaagaagtccacggactgtgtgaacaatacggatgcagttatgaacaggtgaaatcctggtatgatggctatttattagaggattatcaggtatataatccgaaggccgttgtcagtgtcatgttaaatggaaagtataaaagttattggtcaaataccggaagctatgaggcaattgtgccactgatcaacatggattttgatggcttgaaatctgcaattatcgagatgttgtcgggcgcatccgtagaagtggatgtgacatcctttcagaatgacacggtaagttttgcaaatcgggatgatgtgcttacgtacctgattcatttggggtatctggcttatgatcaggacagccggcatgtttttattccgaatgaagaaatccggcacgagttaaatcatgcagtgaaacgtaccagttggaatgagatgatgacatttcaaaaagaatcgttagcgttattagatgcaacgctggaaaaagatggaatggaggttgcaaaggggattgagaaaattcatactgggtattcttcaacgattatgtaccatgatgaaaattcgctcagcagtgtacttacgatcgcatacttaagttccatgcagtattattttaaacccgtccgggaattgccgaccggccgtggttttgcggattttgtttatattccaaaaccggaatataaagctgattatccggcactggttgtggaactgaaatggaataaaactgcggataccgccttacaacagataaaagacagaaagtatccgcaatcgttagagccatatacaggaaatattctgctcgtaggaatcaattatgataagaagacgaaagaacattcctgtgtgattgaaaatgataaaaagcaataagcgttaagcttcgtctttttgcaggattgaaacaaatcccgcaacaaaactaaacagaacaggaagaaaccaatggaagaaaaaataatgcatcttctgatcacagaagacgatatggcactcgcacagggactgcagcgcgcattacaggagaaaaaccggcaggtgctatgctgtaaaaatatacaggagaccagacagcatctgcatcagaacaagacagatctgctgattctcgatgtaaatctgccggatggaagcggttttgatctgctgcaggagatccgcagaacctcggatcttccggtgatcttacttacggcaaacgatctggaaatggatattgtaagcggactggagcagggagcaaatgattacatcacaaagccgttcagtctggcggtactccgggcgcgggtaaacacccagcttcggaaccggacggcgcagatgcagaaagaaagcgcaaaaaatacacagatctgggagggcagtatctggaagtttgattttacaaatatgcgttttaccgtaagcggacaggaagtggagttaagtaaaaccgagcagaaacttctggcgcttcttgtgcagcatgtggggatgaccgtgccgcgggaaactttgatggatcgcatctggaccgatggcgcggtgtacgtggatgaaaacgcgctttcggttgccatcaagcggctgcgggataaattacaggcaaaggagcagatccggaccgtgtatgggatcggatatgtatgggaagtatgatcggatattttgtaattatattgcttgcggcagggagtgtgcttgcagcagcacttttcttcagacaccggcagaaacaggtgatggatggactttccgatatgcttgaggcggcgataaacggcaccttttccgagaccacatttgatgagtcgcggcagtcgtcgctggaaaaccgtctggcgcagtatctggcggcatcggaactttcggtgcgaagcatagatgcggagcgggaaaaaatcaaagaactgatcgcagatatttcccatcagacgcggacaccactttcgaatattttattgtatacggaactgctggaggaagaaccgctgggggaagcagcacaggattccgtaaaaaagctgcggcagcagagtgaaaaattacagtttttaatggatgcgcttgtcaaactttcaaggcttgagacaggcgtttttgtgttgcatccaatccggcagccgctgacagaactggtcgtagacggtatggaaagttaccgggaaaaagcagccgccaaaggacttgcgattgcgttttccgggacgaaaaaagcagaggaaggcgcaccggtttatgcgtactttgataagaaatggtccatggaagcactgggaaatattctcgataatgcgatcaaatatacgaacacaggagggattaccataaaactctgttcctatgaactgtttgcctgcgtggaagtgacggatacgggaatcggcatcggtgaggaggagcatgcggcggtatttgggcgtttttacaggggaaacgcggttgccgaaaagagcggtgtggggatcggactgtatctggcacgttttatcatgcagcagcagggcggatatatccggctttcgtccgtgcctggggcaggctcaacgtttgggctgtattttccaacggcaattgtgtcaaaactgtaagaatcttttttctccgggacagattctcgaaagaattctgtgcgacaatcttaaaagaaggcaggaaatgccaaatcaggagcaaaaggagattacaggatggtcattttggaaaccagagatttgaaaaaacagtatggcacgggggagaccgccgtgcacgcgctggcgggggtaaacctgtcggtggaaaacggagaatttgtcgcggtggtaggaacctccggatcgggaaaatcgacgcttttacatatgcttggcggactcgaccgggcaacatccggcaaagtctatgtggacggcaaagacatctttgcattaaaggatgaagaactgacgattttccgcagaagaaaaatcggatttgtctttcagtcctttaatttagttccggtgctgtctgtctatgaaaacattgtgctgccgctgcagcttgacggaaaaaccgtggacaatgcatttatcggggagattgcagaggcactcggactgaaagaaaaattaaacgtgctgccaaaccagctttcgggaggacagcagcagcgcgtggcgatcgcgcgggcactcgcagccaaaccggcgattttattagcagatgaaccgaccggaaatctcgacagccgtacctcacaggatgtgatggggctgctcaaaacaactagcaccaaatttgcgcagaccattatgatgatcacacacaacgaggagatcgcacagcttgcagaccggatcattcgtatcgaggatggacggattgtgaccgggaaagcaggtgaggcattatgatgcaggtaaaaaaccgtgcctgtgtgcgtaccgttgccgtgcgcagtctgcgggcttttaaaatgagaaacctgattgccgtgattgcaattatgctgaccacgatgctgtttaccgcgctgtttacgattgcaatttccatcaatgattcgttccagcagtccaactttcttatggccggaggcgatgcgcacgggtcttttaagaaactgacggaagaacagatggaaaccttaaaaaaagatccgctcattcgggagacaggtgcgcggctgtttttaggaatgggaaccggggatgcatttcgcaagacacaggtggaagtcagctatatggatgcgcatgaagtaaaacattatttttgcacaccaacgcacggacatcgtcccaaagagggaagcaatgaggcgatgacagatacccgggtgttaaaactgttaggagtacagcccaaaatcggcacaaaatttaccgtgacgtatcagatcggaggaggtcagtcagaaccgaaaacggtgacgcaggagtttgttctctccggctggtgggattacaacggagtttcccaggcaagcaatgtgatcgtgccagaaagttatgtgaaaaagacattgcagaatgtggagatcggggaggatgaagagagtggaaaatggtcacttgacgttatgtttgggaatgcacttcatatcgaaaaaaatatgcggcaggtgatcagagactgtggatttcagtcagaagatgcttccaaaccgggctatattgcatttggtgtaaactggggctataccggtgcgcagtcgagcagcaatctgaatgcggaaagcattgcagccattgtggcattgcttgtgctcattgtatttaccggctacctggtcatttacaatgtgtttcagatttccgtcaccaacgatatccgtttctacggactgttaaaaacgatcggcatgaccgggcggcagcttaagcggatcatccggctgcaggcagtccttttatcagttattggaattccggcgggacttcttctgggatttggaatcggcgtgggactggcaccggctgtcatggcacagatgagttacacgacagcggttataaaattgcatgcgtgggtatttgtgggagcagcacttttttcactggtcactgtatttttatcctgcaataagccggggaggatcgctgcaaaggtatccccggtcgaagcggtgcgctatacggaggcagactgtggcagaaaaaaagcaaaagcggcaaaaaaaccggcatctttggggcgtatggcatgggcaaacgtgggacggaaccggaagaaaacggttcttgttgtcatttccctctcccttgcggtcgttcttttaaatctgaccgttatgtttgcaaacggatttgatatggatctgtatttgaaacatttctgtgtgagcgactttgtgtttgccaatgcggattattttaacgtgcagaaaggcttccattcttccgatgaagcagtagaagattctgcaatgcagaccgtgctcgcgcaaaatggcgttaaagagagtggatgtgtctacggacagacaacccgggttttggaaaaaataaagaaaaaagatatgctggcgtattttacatccatgggacatactatgacaaaagagcaggaaaagggttatttcaattggaaggaacaggcagatgatggcagttattatgacgatattcagttgtatggaatggatgcatttccgcttcagaaagtaaaggtgctcaaaggcgatgtcacagctctggatcaggagaatgccattgcggcagtctataagcaggatgattatgacaaaaaagttgatcacagtaactgggccggggtgggcgatcaggtgacactcaggtatgtaaacagttggaaatattttaatgcagagactggaaaagagattccggaggaagagattgacagctacgaaggtgcatgtgacgtggaagcagatgattatacacaaaaaacctatacggtggtggcagagattctggtgccttccgcgatgaactgccggtattatggatcgccgcagtttgtgcttgggagtgatacgtttatcaaagataccgggacaaaagatgtcatgcatatgatgtttgatatgaaaaacaatcagagtgcaagagcaatggaaagttttttgaaaaattatacggaacaggtcgagccgctgtacagctatgaatcgaaattttcctacgaaaaagagtttgattcgttccgtgggatgtttctgctgcttggaggtgttctctccggtgtgattgccgtggtcggaacattaaatttcctgaatgccatcctcacggggatgattgcaaggcgcagggagtttgctgtgctgcagtcggttggaatgaccagacaccagttgaaacggatgcttgtgtatgagggactgttgtatacgtttgcggcgattgtcatttcgcttattcttgttgtggcatctgagccgtttatgggaaagatgattgaaaaaatgttctggtttttccggtttcagtataccatcggtccggtcgtgcttgcggcactgatctttaccgtgatcggcgcgggggttccgcttgtggtctattgtgtggttggaaagcagacgattgtggagcggctgagggagacggagtaaaaaagaataacaaaacatttccgaataaagcctgaatccatgtggcataagaagcaattcattcggttactttgcttttcaggacagatgtgatatctgccgaaagcgttgctgaatgttccacaaacagagcaataaaaataaatatttctttaattttgaaaccatactatttacataaatgaagccgtaaggtaatcttaaaaaatatgtaaaatatgcggatcataagaaagaggtttatggatgaggaagaaacggatcacagttataattggcaggatgttttgtggcggagcgtttaatctatggaacagacagaataaaaccaaaacggcaatgaaattatcagctgttgttatgctcctgtgcctgatgctgggggcatgtgcacagaaacagaagataccggctgcaacttatatgggaggaaaccataccattacagaaatttgcaaagaactggataccgcgggagcttcccatgtagatacattccgggaatgggtaactgattttgcagattcggccgggaagaatgcaaagcttgaggatgtctggtctgatccggaaaacatgaaagcagatatcggcaaatgtatggatggctgggaacagaatcatgattactccgacacggactgcagaatgacagcctttctcttactggatggtctgcttcacgcagaatcaacggaagacaattatgaaggtacttatctaatgtttgatacagaagcaatagataatgtggaaaggtatgaaaccataaaagagaaccgggatatgtttaccacactctatggagaaaagagtgttgcagataaaaaacatccggaaacagcattttcggatagttggaaacattatggatttcaaatagacagtgacaggatatcgctccttagtatcgtgatatatgacccgtattcggatgttactttcgtgggtcatacaggtatcctgataaaggacagggacgattacttatttgtagaaaagattgcatttgaacagccatatcaggcaacaaaggtgaagacggtggatgaattgctcaatattctgtcattgagaccggaatatttcggagaagagggagaagccggaccgtttgtttataataatggggaatatattggaacattaaaggcgaaggcatagtagcaaaaaacatttgacataccggaaatattcctctataatcgttctaaaaagaacgatgaaggaggaagagaagatgtacttctgggataagcataaaacaattacaagttattatgaattgctttccggagaggtatgtgaccggtatgggctgacacagatggaatacgatatacttatgttccttcataataatccgcatcacaataccgcagcagaaatagtaaaggttagaaaatcaacgaaatcccatgtttcaacttcgttgaaaaaattggaaaataaaggactggttgaaagaatacaaagtaaggataataaaaagcatatagagattattctgctggatcgggcagaacttatagtggcggcaggaataaacgcacagaaacagtttgcaggaaatgttttgagcggactgacagaagaagaaaagcacatgtgtattcaggtatttgaccggatctgcaataatgcggaagaacatttaagggaatacaagaaaaaaacgaatgaaaacgaatccctggatatgaagagtactgggaatcatttgttttacagtcaattgatggaaaaggagcaggatcaaaaggatggaagagaacaattacaaaccacagattccggatgtgatggaagcaatatttgatgctgcgtatctgattttcgatttagttgccgcaattttattttttacattttcaaaaggaaatatcttatttgtactttatggaatattaacattgacactttgcggaggggatgcttttcatctggtgccaagaattataagggcagttcgtggaagcgatgagaagataaagaggcagctgggaattggattgcaggtatcgtctgttacaatgacggtgttttatattattttaatgtatgtctggaaatttacatttccggaaatgataataccgacaatagtggaagcggtcgtgtggatatcagcggttgtcagaattgtgatatgcatgtttccacagaacaattggtgtacagatgaaggaaatatgaaattatcaattgccagaaatgctgtctttgcgttgacggggatcggagtgattattctgtatatcatctccgggaatgcgaatgggtatggtatgacaagaatggttgcagcgatcattctttcttttggctgttatctgccggttactttattcagtaaaacgaaaccaaaggtgggattattaatgattccaaaaacctgtgcatatatgtggatgattgcaatgggactacaactgttattttaaaaacaaaaatattatagaggcagggcattataatgaaaatggaaaaatttgtaaagcttatgacgggacattttgataacagagaacaatttacagaaatgaaatctgcaggaaaattatttccgtatgccagacatgtgaatacagtttgtaatgataagataaataatattccggaaaattttaccggaatatttatggtagaagaaagttattatgagacggatggaaaatgccatgcatcaccgcatttatttcttattacggattgtgacggtggaattatgctttcttcctacgaaattccggcaggagaagacaaaaatacgttttcttatgcttccatgaagaacgtagaatatagtgacctgaaaagatctgagaagtttaccccggcattgtatcaggaaaaggatggtgtctgggaagggggaagtgtgagtcagtttacccctgtgatgacattccggttatgggagagattctcggagacatgtctggaggtgtccgaaagtatggaagtgaatggaaagaaaactttcggatatgatgtgccggtcatttataaaagggaacgaggtgcctgacaccagttccgtgggaagcatagatgctgaaacggtagcgcttgcacgatcaattaaataagcactagataaaagagtcatccatctggatggctcttttattgatcctgatatctgcgcggatttcgacaaacagctcttatggtaaatttaaagaaattaaaaatttttatatcgcatggttttctttttctgcttgacaaataccatttgattgttcctatacttttttgaaaattctggtatttctttaggtatgaaaaagttcatagaaaattcagttgattccgtaaagttcctcgcttataatgatattgaggcagagagccttttgcggaatcttagaagtgttatgcacaatacaaaaggagggatgccgacttgaatacagaaatagcaaatgctgtgaatgcagcaggagataaggcacaatatgatactcgtgttaaaaggttactggcacagaagattatattagcacatattctggtgaaaacagtcgatgaatttaaaggaatgaagccggaagatgttgtgaaatacatcgaaggcgaaccgagtattagcgttgttccggttgagccgggattagcaaatatggaaaaaacagatgctgcaggacagcgtatcgtaggtcttaatacggaaaatgctgaaattaatgaaggattagtcagatttgatattattttttatgtccgcatgccatccgtagatgacacaaaaaatggactttcgcagattattgtgaatattgaggctcagaaggatgagccgacggaatataaaattttaaatcgggcaatcttttatgtgagtaggctgatttcgtcacaaaaggaaagagattttgtaaatactaactacgacgacattaagcaggtattcagcatatggatatgtatgaacatggatgataacagcttaagccacatccatttgacaaaagatgagatgttaaaaccatgtaactggaaaggtaatctcgatctgttaaatattgtgttaataggaatcacaaatgagattccggaacatgatgaaaaatatgaaatgcaccgcctgattgggactttgctttcaggcgaattgaaagaacaggaaaaattggatattatagaacatgaatataatattccaatcagtcaagaatttagagaggatgtgagaattatgtgtaatctgagtacaggaattgaagaaagagctactgaaagagctactgaaaaaacaagcgaaaagtttattctgaatatgtataaaaagggttatacattggatcagatcgcagatgtagctgaaacaggtgttgatgaagttgaggcgattattaagaagaaagagcctgcaatggcgtaaacatcatggtaaaatagtttaaaatgaagatgcggcaaaatcgtcaacaggttgttgaggagttgccgcttctttgaattttatgttattttgataaatcttagtctggcataaattgttgcccccattcgcacatagagtccaataaaggaatcagtgtcttgcctaactcgcttaagctgtactctgtttttggaggaattacaggatatatttttttaatgattaagttatcgttttcaagttcgcgtaactgctgagccagcattttatcagtgatagctggaatttttttgtggatttggttataccttagcgtgttgttgccaagatgatacaatataacggctttatattttccaccaattttagatatcgttgcatcaacaggacaattatatttgttttgcatttttacattttacactttctttttagttagtatattacaaaaaagtacgttcttgtcttttttatatcgaatccattataatcaaattgtctagacaatacaatcataattttaaggagattttacagaaatgaatattttagatattgcaaaacagcgtttttcagtaagaaactatctgactaaagagatttcacaggagacattggagacaattttagaagcagctcatgtagcaccaaccgcagcaaatatgcagcctgttaaactattggttgtaaaaagcgatgaagcaaaagaaaaactggcaaaggcagccaatatttacagtgctccagttgcaatcattgtgtgtgcagatacggataaagcatggacgcgtccatttgatgggatgaaaacaacggatatagatgcgtcaatcattaccgatcatatgatgcttacagctacagaacttggcttgggctctgtttggatttgttactttaaaccagatgtgataaaagaagaatttaaacttccgttgggacttgaaccaatcaatatattggcgattggatatacgaatgagaaagcagatgcaaatagacatgaatcccagcgtataccaatgaaagaatttgtttcattcctttaatataaaaattatatatcagctcaaattgcagatgtaacagaaaagagcatatctgaaattgagaaaattgtaaagaaagagccagcaatggcgtaaatatcattaacgaaataataaaaaataagagacggcaaatcgtcaacaagttgttgataatttgccgtctttgttggtatatgggagttattcctctttttttctagcccttgtcttatagacattatactgattcttgcatttcggagagcagaattcatttcccttacggcttgcgataaatgccctgccacagtgcttacacagcttcatatcgcagtcagaatccgtaagcataaaagaaaagcacatctggatcatgacgagcagggaatggaagttccatacgataacaggggcattttccgctaatgcgatatggtaagtcggggatatgccgccaaatgcagacataccctgacgatacaggttttttgtctgttcatccagactgtcatagtccatatagtataagaaacttgtggtaaaggtaaatgcccagtcggaaaattctttcaccagccagtcatagcgttctgcatattccttctgaaaactcatcgtaacagcctgtgaattctttcccgttgcaagtgcgattgcaatgccattccgcattggtggtgatgaatttgttgtatttgccggcatgacacaaaaacaggttgagtcaaccctgctcgaattaaagcatacaacagagaagtagtctgggacaaaggttgacagagtgagtatctctgttggatatgctcttacggaagaccataaagaattttctattgaggagcttgtgtatcattaagacaacagggaaacaaattccacacgctgatccatccagttcccgataattgcaattccttttcccatggtaaaagctgcaacaatggttccgatgccaagtcccatgatatgtccgagacagaagaacgtcatacatgcggtaataaccagacaggttacatcaaaaccgattttgatgcgggcatagggaacctttgtgatgtctgcggcttcccgcggaaacagatcggttgggatgatcggcagtttgcagcggtttgacagcgcaattccaaaacagatgataagataactcaatacaaagtagaggatgcgaagtggtatattcagcggcagccgcgtaatccacagttcatgcagatccatcatctctccaaacgcaaaccctacaacaaaactaaataaataggatgggacaaatttttttcgcataatcattagaatgcagatcaaaagtccttgaaacaggtaagtccaggtgccgagtgtcagtttcgggaaaacctgttgaaacgcatacggcacgcttgaaatggcggagattccggagccggactgaagcatcagaaggacaccgaggctgttaatgataacggcaaggacaagtgctgcctcaccacgtaagatttttttctgttgtttcatgataatagtgctcttttccgatagattttgtgtgcattgcacacggctgcgattatagtccttttttcacagattttcaagtgtgggttatgtaatggatgcatttccagtgcagaaggtaaccgattgtggagagattgcgtgaaacagaataaattctgataaaatttcttgcaaagtaggtttccttgtggtatatggtattaaaacggttaaactatggaaacagaaacgaagaaaagagggcaatcacaatgtgtacagcagcaacatacaagacaacggatttttattttggacgtaccctggattatgaattttcctatggggatgaagtggcagtcctgccacggaattatgcgcttaccttccggcatatgggtgtattaaaagcgcattatgcgatcatcggtatggcatatgtagtgggcgattatccactgtattatgatggaatcaatgaaaaaggactgggtatggcagggcttaattttgtcggcaatgccgtgtatcagaaaattgaagaagggcgggaaaacatcgcacagtttgaatttatcccatggattttagcacagtgcgcttcggtttgtgaagcaagagaaaagctggagaagatgaatctggtaggaacacagttcagtgagcagcttccggcggcacaattacactggatgattgcggatgaaaaggaatgtattgtagtagaatgtatggcggatggattgcatatatatgacaatccggcgggagttttgacgaacaatccgccatttccgcaacagatgtttttgttgaatcagtatatgcatctgtcaccgaagcagccggtcaatgcgttttccaagcagcttcctctggagcagtacagccgcggcatgggagcactgggcttgccgggagatttgtcttctgcttcacggtttgcccgtgtggcattcacccggctgcatgcgatgtcgggtgaatccgaaaaagagagtatcagtcagttttttcatattttaggttcggtggatcagcagcgtggctgctgtgaggtggcagatggcaaatatgagattacgttgtatacttcctgctgtaatgcaacaaagggtatttattactatacgacatatgaaaatcatcagattactgctgtggatatgcatcgggagaatctcgatggggaaacgctggtgcattacccaattgtgacaggagaacatattttgtggcagaattaaaagggtgacatacacgaggagatggaaagggaagtttgaaatgaaatatattccgttaatcataatattacttctgattctggcaattttggttttgattttttacggagtgtaccgtgtgaaacgtttttccagacaattgtttggcacagatgatattttgcagggcgtaaaaaaagcgcaggaagatctgtcaacaacaccgcgttcggtatcggcaatgacaagaattgccctgccgcagatcgtttccgattttccggattttgagtacaatgaaatgaagcagcgtgcagaaaatgccctgatgcagtatttcgaggcagtaacggcacaggatgtaacaattttacaggaaggaaatgaagatttgaaagaacagcttcgttcgcagattcgcgcattggtctcacaggaaaaatgggaacattttacgcaggtaaagattcatcagacggagatcgctcggtatcggaaagaagctggccgttgcatcgtgacattccagtcggcggtggaaagttttcattatgtgacagatgcagcacatgccgtggtgcggggatcggatcatatcttagagcagagccgctataatgttgatctggtttatattcaaaatcgtgaccttgccaaaggaaataccgatggagcgcttggagtcacatgtccgaattgtggagcaccgatcacgaatctcggagctaaattctgtgagtattgtggcgccggtgttgtggagttaaatgtacacgcatggtcttttgaaaatattgaggaagcataaatttatttgcaggcataagcagaattcttttttgtatgcttgcgtttactgtgatattgtgttaaagtacatattgttctgaatataagaaccatagagtgatgacaggggtcacacgaaggggtacaccaccgcgggtgtagctttcttcgtgtggccttttttgttgcaatataaaaaggaggtcttacatggtacatatcaacggaaaagatatagatgcggcagggcagtctctggcggcatatttaaaggcaaatgattatgagatgggaacatttgttgtggaatgcaacgaggagatcatccataaagaggattatgaaaactatatgctaaaggatggcgatatcatagaaattgtccagtttatggggggtggttgcggtacatctctgatgtatcgctaaggaatgtagcgtcggtccatttgcgaagcaaatttttcaaatcataggaaattccttcctatgattcaaaaacgctccgcggggatgcgcagctcgcggagttgaagtttatgttgaacataccgcttgcgcgcgaaagtgtgcggccaagcgcacactttatttgaagaaaaataccagagagaatacaagaaagaaggaagaaaaaatgaagaatgacacatttacattaggaggaaaagaattctcctcgcgttttattttaggatcaggaaaatattccatggagctgatcaaggctgccgttgagaacgccggagcacagattattacattagcagtgcgccgcaccaacacaaagaaaaaagaaaacattctggactttatcccggataacgtaacattgcttccaaacacttcaggtgcaagagatgcaaaagaagcagtccgcattgcgcgcatggcaagagaacttggatgcggagatttcgtaaaggttgagattatgaaagacagtaaatatctgctgccggataatgtggagaccgtaaaggcaaccgaaatgctggcaaaagaaggatttgtggtgcttccatacatgtatccggatctgtataccgcacgtgatctggtcaatgccggagccgcagctgttatgccattggcgtctccgatcggttctaataaaggtctggcaacgaaagaatttatccagattctgattgatgagattgatctgccggtaattgtggatgccggaatcggaagaccttcccaggcatgcgaggcaatggagatgggagctgccgcagttatggcaaataccgcaattgcaacagcaggagatgtcccggccatggcgggtgcattcaaggcagccattgaagctggaagaagtgcatatctgtcgggactgggccgtgtacttgagcgtggtgcttccgcaagtgatccactgaccggatttttgagagactagggggcgaaatcatggctgaaaatcaattttttattgactccgataagttaagcgaagctgcactggagcgcaaacataaactggaaaccgatccgtcgagcagaacgaaccatatggaatatatgccggggatggaacagatcgatccaaccataagaaataaagtcctttccgagatggacagttacgattacaacaaatatacggcaagagatgtgcagaatgcattagagcatgaaacctgcagcgttgaggattttaaagcattgctttcgccagccgcagaaccgtttttggagcgcatggcacagcgtgcaaagatcgagacaggcaagcatttcggaaatacggtgtatctgttcacaccgctttatattgcaaactactgcgagaattactgtgtgtactgcggatttaactgctacaacgacattcatcgtaagaaactgacttttgaggaaatcgagcatgagatgaaagtcattgcagactccggcattgaggaaatcctgatgctgaccggagaaagccgtgcgcagagtgatgtcgagtatatcggggaagcctgcaggctggcaaagaaatatttccgcaatatcggtctagaaatttatccggtcaacagcgatgaataccggtatctgcacgaatgcggcgctgattacgtgacggtattccaggaaacctatgacaatgtcaaatacgaaaccctgcatctgatggggcataagcgtgtattcccataccgttttgaggcacaggagcgtgcgctgatgggcggcatgcgcggtgtcggattttccgcattgcttggactttccgatttccacaaagatgcactggcttctgcactgcacatttattatctgcagcgcaagtatccatatgcggagtattccctgtcctgtccgcgtctgcgcccgatcatcaacaacgacaagatcaatccgcttgacgtgcacgaaaagcagttgtgccagattctgtgtgcgtaccgtattttcctgccgtatgtcggtatcaccgtttcttcccgcgagcagaaacatttccgtgacggcatcgtaaagattgcagcgacaaaggtatctgcgggagtgtctaccggaatcggagatcatgagagcaagtataccggaaaggataccggagaatccggagatgagcagtttgaaatctccgatggaagaagctttgaccagatgtataacgatatggaaagcgaaggtctgcagccggtattaaatgactatgtctatgtatagaaaaatctgcgtgaccaaccgtgcgctggcagaacgtccttttttagaacagttagcgtgcgtgcttgccacaaaaccgtatgcgatgatcctgcgggaaaaagacctcatggaagaggtatacgaagaacttgcgggaaaagtaaaaaaattgtgtgaaaacacggacaccaggctgattctgcacagtttcccggatgctgcaatgcatctggggggtacggccattcatatgccactgcatcggtttacagagatgccggaagaacaaaagcagaaattttcagtgcgcggtgtctccgtacattcagtggacgatgcgcgcctggcagaacaatgcggggcaacctatctgacagcagggcatgtgtttgtgactgattgtaaaaaaggactggcaccgagaggacttgattttttgcatgaggtgtgcagctctgtgaaaattccggtatacgcaattggcgggattcatgaagaaaatatggaaagctgcatccagtcaggtgcagcaggcgtgtgcatgatgtcggaatatatgaaaatctgatacaggaaaacggataacaaagaggtgaaaacatctttcttgcaatggattttgtaaaggaacatgctgcagcagacggaggagatctgcgtatgtctattttgacatcggagtgggaaaaaacggaatcagatttagataacagaacagggagattgcagcgaatgctgcattctccctgtttttagctgatcatatccaaaaacatctgatggatcttccggtcgctgtcgagttccggatggaaagcaattgcgacctgatttccatagcgtacaccgacgatatggtcatcgactactgagagaatctccacaccgtccgatacgctctctacataaggggcgcggataaacgacattggaactagtccgagatctttaaattctgcctcagtatggaaactgccgagctggcggccgtaggcatttctttttacctgcatcgggattgtgccaaaatgttccggggagcctaaaaggatcaacccggcgcaggtgccaagcaccggcattccatcagcgatctgttttttcaggggatcaaacattctaagttcccggagaagttttccctgtacagtgctttccccgcccggcaggatcagtccgtcatacggctggtctaagtctgccgcctgacgcagttccacggtctttaccccaagttcttccaatacatgttcatgttcgataaatgcaccctgcagggcaagtactgcaacagtcatgtttatttccctctttctgccatcagtaaggcgatttcctgttcgttgattccgaccatggcttctccaagcccggcagataattctgcgatcagttttgcatcggtatagtttgtgacggcttttacgatagcagctgcacgcttggcaggattgccggatttaaagattccggaaccgacaaagacaccttctgctccgagctgcatcattaaagcagcatctgcaggggtagcgacaccgccggcagcaaagttaaccaccggaagttttccgttattatggacatagacaaccagatcatacggtacctgtaattcctttgctgcttcgaaaagttcatcttcccgcaggctgacaacttttgcaatctggctgttgatctttcgcatgtggcggacggcctgtacgacatcaccggtaccaggttctcctttggtacggatcatggatgcaccttcactgatacgacggagtgcttcaccgagatctttggcaccgcagacaaacggaaccttgaactggtgcttatcgatatggtagacgtcatcggcaggagagagcacttcactctcgtcgatatagtcgatctcgatagcctctaaaagctgtgcctctacaaaatgaccaatccggcacttggccataaccgggatggatacggcttcctgaatgccgcggatcatctgaggatcgctcatgcgggaaacgccgccggctgcacggatgtcggcaggaatccgttcgagtgccatgacggcgcatgcgccggcttcttctgcaatttttgcctgttccggtgtggtgacgtccataattacgccaccttttaacatctgtgcaaggtttttatttaattcatactgttctgctgtgctcatcggtattcttctccttttttgttaaaatttgttttatgccggtcattatagaacttgattggatatatgaaaatagccaaaataaatatttattataagaccagaacgataaaacggcgtttaatgacataaaatcacatgatgtagtaataaaaactatataatatagtagacatgtgatgataaatggtgtaatatgatgtgtgacataaagggagtagaaaacggaggcgggatgaagctgaaacagcgcacgatttattatcaggatgaactgcatgacgagtttgccggagatcatattaaagcaaaacatattggacaggattaccggtatatccgggtgcgcccgttggaacgtatgctgcacggattctggtatggcatagttgcaattccgcttgcacgtctttacatgaaactgcatttttcacataaaataataaacaaagaagtgttaaagcaggccggaaatagtggattttatctgtatgggaatcatacacattttctggcggatgcgctgataccaacgctggtaaatcatccgcgggaaacggcggtgatcgtgcatccgaacaatgtttccatgccggtgctggggcggattacaccatatcttggggcacttccgctgccggatgacagaggtgccatgaaacattttctggaggcattgacctggcataccgattgtggagattgtattatgatctatccggaagcacatatctggccgttttataccggaatacggccgtttcctgatacatcattccgttatccggtgcagcagaaacttccggttttctgtctgaccaatacttatcagcgcaggggaaagtctcacattccgcagatcgtaacgtatctggatgggccattttatccggatgcagaattgcctgcaaaactgcaaaaaacgcagctgagggatcaggtgtatgaagccatgggaaaacgggcgcaaaacagcaatatggaaatgatccgttatataaaaaaagacactgacagggagaaatcattcatatgagaaatattcttttttgtggaaacagtaaagtatttgatggtgtgcttacatgcatgttgtctgttttaaaaagaacacatgcaacagatccgttctgtttttatattttcacaatggacatgacgcggatcagaccggaatatacgccgatcagcgaagatatgacagattttctggagcgcgttgcaaaaaaatttcatccgcagaaccgggtgatttcggtggatgtaacagtattatatgagcgttatttcggaggatgtccgaatgaaagtgcttattgttcgccatatacacttttgcgcctgctggcagatctggtgccgggaatgccggataaactgttgtatctggatgcggatattctgtttcagagagatatccggctgctgtatgacaaggatgtgtcacacgtggaatatgccgcggcaagggatcattatggcaagtatctgatctctccggattatattaatgcgggggtattgctgcttaatatgaaaaatatcagaagaaccggcctatttatgaaagcacgaaagctgcttcagacaaaaaaacttatttttgcggatcaaagcgcgattatccgcagtacgcgggcaaaaatgctgcttccacagaaatttaatgatcagaaatttttacataaacataccgtcgtgagacatttttccagacggctgttttatctgccgtatccgcatacggacaacatcaaacaatgggaggtagagcgggtgcatacggtatttcattaccatgcatttgatgacattttaaaagagtatctgtacttaaaacatatttatgaaaaaagtaaacacatataaattgctgcatctgggcgaaacggatgcaggagaggagaaggagcatgaaagagaaaatgaataaaataccggtgttttacgcatgtgatgataattttgtgaaatacacgatggtttcactgcagtcgatgatggatcatgcatccaaagaggcacagtatgaaattcatgtacttcataccaatatttcggaagaaatgcaaaagaagatgcatgctatggagaatgcgaatttttctgtgcagtttgatcatgtgacggaatatttacattccatacaggagaaacttccacttcgggattattattccaaaacaacatattttcgtctgtttatcgcggaaatgtttccggaaatagacaaagccatctatatcgacagcgatacagtcgtgctgggggatattgcacaactgtatgcttatgatcttggagatgcttatgtgggagcgtgcagggaacaggtgatgattcaggaagaggtatacggcacttatgtggagaaggtgcttggggtagaacgtgataattatttcaacgccggtatgcttgtgataaactgtgaacagtttcgtaaaaatcacgtgttaaagcagtttatggaacttctcccgatgtacaattttgtggtcacacaggatgaagattatctgaatctgatctgccacaacaaggtgtgctggctgccgcagaagtggaatgtggaagtattcggtcagatcccatgccgcgaagaagaaatctgtgtgctgcattatattatggtctcgaagccatggcattacaatgactgccgcctgcaggaatatttctgggagagcgcacaaaagaccagtgtgtatgccgagatccgtaaggtgcttgaaagctatacagacgaagaaagaaagcgggatgcggagtcctgtgaccgtctgatgcagaccgcaaaggatgagatcgccaaggaaaataattacctgaatctggtgaaagcaggaaaattaaagtccaaagaccgcctggaagtacttgaaaaaattgctttgtacgaaaaagaggggcgttttggggaagatgtggaggaagatccgcctacccgtgagcttcagccgtctgagatcgattatctgcgcaaaaaattaaagagccgtatcaagacaagattgacttacaaagtagcgcggacatttttaaacaagatcattgaaaataaacagctgatcatcaaggatgtcattggaacggaacatatggatgcactgacttccggtgcggtgattacctgtaatcatttcaacgcatttgacagctttgccatgcagattgcctatgaaaaatcaaaacagtgcaaaaaacgcagactttaccgtgtgatccgggaaggaaattatacgaattttccgggcttttacggaatgctcatgcgaaactgttacacgtttccactgagttccaaccgcgatacgatgaagaaatttttaagttccatggatactgtgctgcagcacggagatttcatgctggtctacccggagcagagtatgtggtggaattaccgcaagccaaaaccgttaaagaaaggcgcctatacatttgccgcaaaaaaccatgtgccggtgcttccttgctttatcaccatggaagacagcgacatcctcggggatgatggcttttatgtgcaggaatacacgatacacattacagagccgatttatccggacccacagaaaacacaggcagaaaatgtggatgcgatgcgcagaaaaaatgctgctgtatggaaacagatttacgaagagttttacggaattcctttagtatacgatactgcggaagcagtgcagtatgtgggaaaaccgaccaatatcgcataagaacagataccagaccgccggaggatgcctccggcggttttttcataatgggattgacagaaaagcagtgtgagagtactatactacttagcaatgctaaatagcaccgctaaataaaaagaaaagggatgggtatggaagaaaagtatatacagcagtttaaaaagggcgcatacgaaatgatcctgctttcgctgatcgcccaaaaagaaacatacggttatgagattctgacggaaatacaaaaacagggtggtgaaatctttgcatttgccaaagagggaaccatttatccgatcttgtaccgtctgacaaaggcaggacttatccagtaccgcctggtgccggcgaaagcaaacgggggcgaaaaaaaatattattcgcttaccggagagggaaaagatatgctcgaaaaaatgaaaaatttctgggaaaactacaaggattgtgtggatggatttatgaaaggggatgcgtaatatgaacagagaaacctatatacggaaagtaaaaaaacaactggactgttccgtgaaagaaaaagaggagatcgtgcgggatcttcaggagatttttgattctggaaaagagcatggaaaaagcgaaagccagatcataaaacagctcggaaaaccgcaggcgtatgcacaggcgctcggctgtggcagacagaccatgccgctgtccggaaaacgaaaagttgctgtagtgtttttggcggtgggtggactgttctgtctgtatgcactgggcgaaagtctgcggtttcggatgccgaaaaatgccattggcggtggggatgcgatgacgatgatcgtgctgcaaaactcgtcaccggtaaacagcagcgagatttttgggggattggcggtcatttgtatggttgcactggttttccttttacgaaagaagaaaaaataaggagaggaatattaagaaataatggaacacataaagaaaaaactagcagtaattgttgtgtttttcgctgtttttattggaattgttacaatctggacagtccgaaaacaaagccagccaaaattgacagcggtcacatggaaattggaggaagaagcggatttagacggcaacgagctttcatcctacgcaaaagatccttccaaaagcaaggtcgttctgacatttaaaaaagatcagacctatcggtgcaaaaatcttgaaaacaaaaaaatctggaagggaacatacacactgtcgcgtacaaaatcgaaagatacctacatgctgcatctcgttccggatcagggaacggcatcgtactatggcgtgtacgggacacgcgagtatgaagatggtaccgggcacatgtcggtcatactgaccacaaaagacaaaattttatcattccttgcagaataaggaaaagacagcaattccggctgttccttttactgtctgcggaactgtgcgggtgtcatgccggtaagttttttaaacatcacgataaaatggctggaatccgtgtaaccgacatcgtgtgcgatctcctgaattttgcggtcacggcgcataagcagcagttcttttgccttggtgatccggtagtttgttaaatattcgtagacggagcagcccaggtagcgcacaaacaggcgggacaggtattgcggggatacatagacctgccggcataacttttcggcggtcaggtcttccatatagtgtgtttcgatcagccgcaatacgggctcaacatatttttcccacaggggatcgctggtatttgcgtggaaaaatccattggaaaacgttagcagcagtgcataacagtcgcaggaaagctggtgtgtattgactggtgctgttttaaaacgtgctacagcacggtcgattacagctttgatttccagagcattttccttttctgtaaaaattatgcggttgttgccaagaatctgcggcagatgtgcttccattgtaccgccaaatgttgcaaaacacgtaatccatgcagaggtgtctgctgcacggtaagcatgtgggacatgcggtgtgatcagaatgccgtgatcttcaggcaaaaaatattcttttccgtcaattgtgaagatgccacagccttcttctgtctgcaaatagtgatagattgggtaaccttgtggacggctgagcgcttcctgcagccagtggtttccaacggaatcaaactggaatggttctttgctgagcgtgttgctgaaatagattgccatgagatatctccacttcttttttctatggcatcatagcatatttcaacagaaaaagaaatagtttcaaaatgttatataaattggtttatcatgttatacaaatataaaagattgtatcgtataatagggaaaaatcaacgaaaacaaaaaatgagacataaattcagaatcgaaaagaaaaggagaaaactatgagcacgcattttaagagaatcctctacggaggagattacaacccgaatcagtggccgaaggatatctggcagggagatatgcgcatttttaaggatgcacacatcaataccgcgacaatcaatgtattttcatgggcaaagatccagccatcggagcatgaatataattttgatgagcttgacgagatcgtggatatgctttcgaaagaaaattacgatatcgtatttgccacttccacggcagcccttccgggatggatggtgcgtaaatatccggaagtgatgtttactgattatgaaggaagacagcacaaatttggcggccgtcacaatgcctgcccgaattcttttgtgtttaaacattatgcgcgtgaactggcatataaactggcagagcgctatgcagacaatccacatgtgacctgctggcatgtcagcaacgaatatggaaacgagtgtttctgtgagaactgtcagaaggcattccgtgtgtggctgaaagataagtataagacaattgatgcattaaacagggcctggaatatggaattctggggacataccgtttacgactgggatgatgtggtaccgccaaatgcgttaagtgacggaatcggaagtgaaaagactgcttttgcaggtatttccattgattatcgcagattttattcggacagccagttagcatgcttcaagatggagcgcgacgcgatccggagtgtcaagccggatgcatttgttaccacaaacctgatgggaacattcaaggggcttgattatttcaagtgggcaaaagagatggatgttgtatcctgggataattatccttcctatgatactccgtggagcagcattgccatgacacacgatctgatgcgcggtttaaaagatgagccgtttatgctgatggagcagacgccaagccagcagaactggcagaaatacaattccctgaaacgtccggggcagatgcgggcacaaagttatcagacactggcacatggggcagacacgatccagtttttccagcttcgcagaagtgtgggcggatgtgagaaattccatggcgctgtgattgcacatgcaggaagtgaaaatacccgtgtttttcgtgaggtggctcagcttggcgcggagctggaaagctttggagaccgtactttgggatcacgcaatgaagcggaagtcggactgattttcgactgggataattactgggcactggagtacaccagcggtccgtccgaggatttaaaatatgtggatcagattcatcagtactatcagtatttttacaaaaagaatatcggtgtggatatgattcctgtggatgcggatttttcaaaatacaagattgttgtggcaccggtgctttatatggtaaaggatggaatgaaagaagcgctggagaattttgtgaaaaatggcggtattctgattactacgtttatgagcggaattgtcggacagtcggataatgtatatctgggcggttatccgggaccgctccgcgagatggcgggggtatgggttgaggagattgatgcccttgcaccggaacagaaaaataaggcaaagtttgcagacggcagtacagcagcatgcggtcttttgtgcgatctgatgcatttagagggtgcgaaagcacttgcctcttatgaggaagatttctatgcaggaatgccggcagcatcgaagaatacatacggaaaaggtaccacatattatattgcaacccggtttgaggaagaagggcttgcaaagattttggatcaggcagtccaggaggccggagtttcatccgttatcccggaagaaaccggacttgaagttgtcacacgcgtcagtgataccacgcgattctattttgtcatgaactttacggatgaggagcagattctgccggagagtctgaccggaaagaaagacatgatcagccaaaagatgacagaacacggaatgaaattgaaaaaatgggatgtccttttactggaagaacatctgtaaacaaaagacagcgccggaatccgagaaagtggatccggcgctgaagtttatgttgaacatatcgctcgcgcgcgaaagtgtgcgacaagcgcacactttattttttgtgatacgtggataaatacattttttcaggaacgggcataggaagtgcccagagacagaatctgaaggcgtttcctgaaatcttcggcattttcaaaatgtccctgtaagatgtcttcttttttcacaatgatgtcctgtaccgttttatccgtcaggtggaaaaagttatcagaaaaaataacatctgcatcgtcaaaatccaaagcgacaaacggagcaaagcagtcactggaaatgtgcaggataaaagcatcattcgtttcttttgcttccgtggatataaccgggtttttaagatttaaatatttatacggcacaagtgtttccacatcctttaacactttttgatcttttgtatgtatcactgcttccaaaaatacatcgtctttttgatcttcccaggaacagatatcgacaactgctgtttcgatagcggaaaaggccggggagttccctttggtttcgtatgtttccagcacattccctgacaggtcacgaatggacagggtgagagaatactctgtggtttcgaaggattcgttggaaaaatatacgtggcacctgtgatcttccagcgtcatactgaccgcgtgtggggcataaaatttctgagccatgtaatgcagggctttccatctgccaaaataatcaatgctggaccaggaaggtgccggccagtcatcgttgatctgccagtagagggttcccatacagcggccgcggtttcggcgccagtggtccacaccgtatttgatggccataccctgtaatacctgactggcatacaggagatgtgtcagatcttttggatagcgcagattttcggacagatagtagagcatcttaccgtttgccgcatcatttttctgatggctttccatgacacgggagaaaatattgcggtcatcttccaaagtaaaactgttgacggtctttgcacatgggaaagactgaaaaccgaattcggagcagaaacggaaaaaatatttgcggtagtcggtaaatggtttctgtccatgccagacatcccagtagtgggtatctccgcggtttgcatcatccggattgtcaaaacagccgccggatgacggggaagaatgccagtaaaaggtttcaccgtctgcctcctgtacggctttcgggaggacttcttcaaacaatctgatataatcggcacgaagataaggagtttctttctggaaatcgccccagtgatcccaggcagattcaatttcgttgttgccgcaccataaaccaaggctggcgtggtggcgcagacggcgcacattatcataggtctcctgcctgcagttttcggcaaacgcgtccgttacatcgtagacattgcaggcatacatcagatcctgccatacgatcagccctttttcatcacagagatcataaaaagcatcggaagggtagtaaccgccaccccatacacggacgcagttaaagtgtgccctgcggcagctttccagaatataatccagcttcttttcggtaattcttgtgtacagacagtcatccggaatatagtttcccccgcgggtaaaaattttgacaccattgacacagaaggcgaattcatttccccattcgtctttttcctggctgatcgttaatgtgcgcagaccgatccgtctggtgatagattccaggcttgttccgtcctcatccagtaaagtggtcctgacgatataaagaggctgatcgccatagtcattcggccaccagagttttggattttcgatcacaaaatccaccgctgccacaccgtctgcatttgttttacacagtttcgtctgcagcggtttgtctgcaccgtcttctgagagttccacgcaaagtttttgtcccggaacggattcggaaagtgttatggatgtctggacggaaacgtttttggcatgctgctgatggatgcggatgtcttcgattctggcatgggaatatccctgcaaataaatgtcccggaaaattccggcatcgatggtctgtggaccccagtcccagccaaacatggagtgtgctttgcgcaaaagctggtttcctttcatggagccgcacggaatataattgatttttttatgggcttcataaggataatcttcgataaaacgcagcacagaacgaaaaacaatctgaatttcgttttttccggggtgcagaagtttttttgcctggaatttccaggtacggtgcatgttatctgtttttgcaaggaatgtgccgttgatgctgatttccgcaagtgtgtcaagtccttcacacaccagaacaatatgttgttgggccaagagttcttcatcgacatcaaacgtccgggtgaaaacataatccttccagaacaatgcgcgtgtagcatcctcattggtacggtaaaatggatcttttatttttccggcggcaagaagcccggaaagtacagtgccgggaatctgcatatctacagattctaaagaacggtgtccggcagaaagctgccaggttccgtttaaagtacaggtttgcatgttatatctcccctcttggtaatcttttcattattttcttgattttatcacagaacagttcatacaacatctatctatcttgcaaattgttatgcattcttttgattttgcaaaatccttaaagttttcttaaccaggcatgaacagttgaagggacagtggaaattttattcgggattgtgtatactgaaactatcctgacaattgcagattttcagaaaagagggaaatactatgaagaaaagattatacaagagcagtacagataaaaaggtttgtggagtatgtggcggaatcgcaaactattttgacgtagatccgaccgtgattcgtctgatctgggtgatctttacacttgtgggtggcagtggactgattgcatacatcattgcggccattatcatgccggatgaaatgtaacataaaatgatagaaaaccgaaaggagaattaataaatatatgtgggcttacgaaagtgttttttatcagatttatccgcttgggttctgcggagcaccatttgaaaatgacggtgtgctggaacatagaattgaaaaagtaaatgactggattcctcatattaaaaaattaggggccgatgccatttatttttctccggtatttgcgtcggacacacatggatacaataccagagattatacaaagattgatacccgcctgggtacaaatgaggatttcgcaaatgtatgcaacaatctgcacaaagaaggaatccgcgtggtacttgacggtgtattcaaccatgtgggaagagggttctgggcatttcaggatgttttgaaaaaccgggagcagtccccttatgtgaactggttcggacgcattgcctttgacggaaattccaactacaatgacggcttatggtatgagggctgggaaggaaactatgatctggtcaaactgaacctgcgcaatgaagaggtgatccagcatatcttttctgccatcaaaggatgggtagacgaatttgatattgacggactgcggctggacgtggcatattgtctggatcatgattttgtgcgcagactgcgcagtttctgtaatgaattaaaaccagactttttccttgtcggagagacactgcatggggattataaccagctgatgaacgatgaaatgctgcattcggtgacgaactatgagtgttacaagggattgtattccagctttaactgcatgaacatgtttgagatcaatcattccctgcttcgtcagttcggaccggaaaactggacgttatataagggaaaacacctgttgtctttcgtggataatcatgatgtgacccgtgtggcctccattctgaccaataaaaatcatctgccgctgatttacgcgcttgcttttgggatgccgggaatcccatgcgtatattacggaagtgagtggggcgcagaaggacgcaaagaagatggagatccggcacttcgtccatcgtttgagaaaccggagtggaatgatctgacagagtggatttccaaactggcagaggcaaagaaacagtccaaagcactgcagtatggaaactttatatctaaagttctgaccaatggacagtgcgtgtttgaaagagaatgggaaggggaacgcgtctacgttgcgatcaatgcggcagacagtccgttttatgcaggatttgatgccggagcagcggaagccaccgacctgatcaccggagaaaaaattgcattgaatggtggatttgagattccgggatatcgtgcgtttttcctgcgggtgtaatatggtagcggattttgaattaaagaagctggtaaagccattgcaggactggtttgatgggcatgcccgcgtactcccctggagagatgatccgaaggcatataaagtatggatttctgagatcatgttacagcagacaagggtagaagccgttaaaccttactttgcacggtttatggaggcacttcccgatgtggaggcgcttgccgcgtgtccggaggatcgttatctgaaactgtgggaaggacttggttactacaaccgtgtccggaatctgcatgccgcagcggaacagattatggagcagtatggcgggacaattccggatacggtggaagaactgcttcgcctgaaaggcatcggaagctatacggcaggagcgatcgcttcgattgcctataaccggccggttccggcggtggacgggaatgtgctgcgggtgatttcccgtgtgtgcgcagatgattcggatatcatgaagcagtcggttcgcagtgcgatggagcgcagcctgcaggcgatgatggaaacggaagtaacaaatggtctgattccgcgcaaatttaaccaggcactgatggagttaggcgcaatggtgtgtgtgccgaatggggcaccgcattgtccggaatgtccatggtatggattctgtgaggcacgtctgcaggataaaattgacacgattccggtgaaaaccagggcaaaagcgcgcagaatcgaggagcgcacggtgtttgtcatccgggacggagaacatgtggcattgcgcaagcggccggcgaaggggcttttagcaggtctgtatgaacttttaaatgtttcgggtatcttagagcagcaggaggctttggaatatgtgaaaaaccaggggttttcaccgatacggatacaggcacttgcaccggccagacacattttttcccatgtggagtggcatatgcatgcctatgtggttctcgtagaagaaactacggcaccaaaagaaaatattttatttactgaggcacagaaagcagtggaaaactatgcagttcccagtgctttttccgcgtattggaatgccattaagatggaaatcaaagagtaagcaaaagagctgtccggacaggacagctctttttatgtgttatgagaaaaaattaatctctaaaaaagggaggacctcgcgccttgcggtgcgaggattatgaaaaagaaaaagtttatttcttaggtatgactaaagtatagtttgcaattatgacgccggtgtgtggagtttatgagagatttgtaaataaattatgaacaaaaataacaatggaaaaagattaagcaaatgttaagataatctctctcgactgtttataaattctcatttataataggtctatcaattattttttcagcaggtttgtacgaagggaaaacatatgaaattattaacatttacaataccgtgttacaattcacaggattatatgcgtcactgcattgaatcgattcttccgggaggggaagatgtggagattctgattgtggatgacggatcaaaggatgataccgctgcgattgcagatgaatatgccgaaaaatatccaacgattgtaaaagcaattcatcaggagaacgggggacatggagaagctgtgaatgcgggaatccgcaatgcaaccggtttatattttaaggtagtggacagtgatgactgggtagactggaacgcttatcaggcgattcttgcaaagcttagggagattgcagggggaagtgtggcacttgatatgcttctggcaaattatgtatatgagaaggaaggggcaaaacacaagcgggtcatgcgtcagaccggttttccgaaagatcagatctttacctggagtgatgtgcggcatttttataaaggacattacatactgatgcattccgtgatctaccgtacaaagctgcttcgggaatgtggacttgaactgccgaaacatactttttatgtggataacatttatgtatataagccattgccgcatgtgcggacgatgtattatatggatgtggatttttaccgttattttatcggaagagaggatcagtccgtcaatgagaaggtgatgatcagccggattgaccagcagatccgtgtgaataagatcatgattgacgatgtggatctgaataaagtgtccaattataaatgccggcattatatgataaactatctggaaattatcacggttgtcacgacggttatgctgctgcgttccggcacagaagaaaaccttgagaaaaagcgtgaattgtggcggtatatcaaaaacaaggatatcgggctgtttcaccgcctgcgcaacggcattatgggacagaccatgaatctgccgggaagaagcggaagaaaaatttcagttgcggcataccgtctgtcgcaaaaagtggttggatttaattaaaaaggttcactgtcttgtcacctgtaaagatatgtgctatactgcatgtcaaacactattgaaatattcatacagaaggtggcaaaaatgaaaacagatattctgatcgtgggaagcggatgctccggtttatactgtgcattaaatcttccgcgggagaaacagattacaattattacaaagtcagatgttaagagcagtgattcttatcttgcacagggaggaatctgtatgcttaaggatgacagtgattatgacagttattttgaggatacgatgaaagcgggacattatgaaaatgaccgggaatccgtatcgattatgatccgttcgtcacaggatgtgattcatgacctgatcggatttggcgtggattttgcccgtgacgagaatggcaatcttgcatttaccagagagggagcacattcggacaagcgtatcctttttcatgaggatattacaggagaagaaattacaagcaagctgcttgctgctgcccgcaagtgtccgaatattaccatattggaaaataccaggatggtagatattgtgacgaaggataactgctgttacggaaccgtaatccgcagggaggacggtacaattgaaacggtggaagcggagcataccgtctgggcatgtggaggaatcggaggattatatcgtcattcgaccaatttccgtcatctgaccggagatgcccttgcactttccatcaaacatggaatccgtttgaaagatgtgaattatgtacagattcatccgaccacattctattcgccggacgaagaggaacgcagttttctgatttcggaatctgtccgcggagaaggggcaaagctttatgacaagaatatgaaacggtttgtcaatgagctgctgccgcgtgatctgctggcagaagaaatttataagcagatggcaaaagatggaacagatcatgtatgggaagatctgcgtaccattccaagagaagaattgatggaacatttcccgaatattgtggaacattgccgtgaaatggggtatgatgtaaccaaagaatgcattcctgtggtaccggcacagcattatttcatgggtggggtatgggtagatcacgaaagccatacgtccatggaacgtctgtatgctgtgggagagacggcatgtaacggagtacacggaaaaaaccgtctggcaagtaattctctgctggaaagccttgtatttgcaaaacgggcggcaaagcagatgagtgggcagaaggaaacgatttccacagcaccggaactgtttgcggcaattgaccggagtatctatgcggatgccgcagcactggcgagccggtatcatgaatatgtacgggaagcgattatcgcggcagatgcaaagatgcagcaggtacaggatgcaaggacaaaggcaacggttgcatttcgcaagcagtgtgcacaggtcggataaaataaaataagaaaatcaggagagagagatgtacgatcaggtaactttaaaattaaatgtagatccatggattattagtgctttaaaagaagatatcacaagtgaggatgtctccacaaacagtgtcatgcctcatccacaggcaggagaagtggatcttatctgcaaagaagatggcattatatgcgggctgcaggtattcgagagagtgtttacacttctcgatgaaaagacaaccgttgaatttttggtgcaggatggagcagaagttcataagggacagcttatggcaaaagtgcatggcgatatccggacccttttatgcggagagcgtaccgcactgaattatctgcagcgtatgagcggaattgcaacctacacacattccgtggcagaattattaaaaggaaccggaatcaaacttctggataccagaaagacaacaccaaacaatcgtatttttgaaaaatatgcagtaagaatcggtggtggaaataaccacagatataatctttccgacggggtattgctgaaagataatcatatcggagctgcaggcggagtaaaagaagcgattgctgctgcaaaggagtatgcaccgtttgtccgtaagattgaggtagaagtagaaaatctggatatggtaaaggaagctgtggaggcaggtgcggatattatcatgctggataatatggacaccgatgcgctgaaagaagccatcgcctatattgacggacgggcagagattgaagtttccggaaatgtgacgaaagaaaatattgcaagactgaccgggcttggcgtagattatgtttccagcggagcactgacacattcggctccgattctggatatttctttgaaaaatctgcatccggtagaaaattaaagaaggtgggattccagaaatgagcggggaagaaaggcgtggaaaaattatacaggcactaaaaaacagtgacaaagcagtttctgccacgacactggcaaaagaatttgacgtgagcagacaggtcattgtgcaggatgttgcacttcttcgggcaaatggaaaaaatatattttcgaccaaccgggggtatctgatacaggaagatgaggagacaacccgtgtatttaaggtacagcatgaagatgatgaggttgaaaaagagctgacaacgattgtggatctcggaggaaccgttgaggatgtatttgtatatcataaggtatacggagtgcttcgggcagagatgaatatcaaatcccgtatggatatccgcaattatatggaggagatccgttccgggaaatccagtctgctgaaaaatgttacttccggatatcattatcatacggtccgggcggaacgcgtggaaattctggatatgattcaggaggaattgcagaagaaggggctccttgcaaaactacaggactatgaacctgttgatttttggggacagaataattataatgagtaaatgactactattgtgattattgataagaagtcaaagaaagaataaaaaggagaaggatggaatgagcgacgagtttacaacaaacgaaaacggttcaaaaacaccggaggaaacaaactttcaggattatacggcaccggaaaatgagatcgtacagaatgaaacatcacagatgacgcaggaacagccggagacttcttatggagcaacgtcggcagaggaaaatccgcagccggacaatacggcatatgcgtatggacagactgcgtaccagcaggcatatcagagtgaacagtcacagccgaatgcatatcagcaggcatattacggacagacacaggcaaagggaacaggaaccggatttggaattgcctcactggttcttggaattttatctgtttttacatttgcatgctgcattaattatattctggcagtgcttgcgattattttcggtattgtgcagattgtaaagaacgagaaaaaggggctggcgatcggtggaattattacagcagtgatttcgattgttcttgggattgccgtttcgctttatgctgtgaatattgcggaaaaaatgcaggacccggacagtccgttttatcagtattttgaagagtatgagcagaaactggaagaaggaaagagttctttctagccgggagttataaaaaggagaacctgttttacaggttctcctttattcgtatatcgatgtctgtgtagtggaattcttcgcaggagatgccctcaatcagataacgggagagcaattctaccggaaggtatccctgcttgtatggctgctggcagatggtagcagtgataatgccatcatcgagcagtttttttgtggaaggaacacagtcgtaagtaaagatacgcatggcatcgatccggccgctttcgactgcggcacggcatccgcctgctacaccgccggctgcaaaatacagcacattgatttcggggtgtgaagccagcatttctttgactttttcataactttcattatcatcatcatgattttctattgtttccacgatatgaatacgttcgcccttttcggaaagcgttgaagtgaaaccctcgatacgatcggagtgacagagtacatgtgacgaaccggttacaataccaatatgaatttccccgaatgtcatcagagaaaccagtccggcagcagtctgtccggacaggcggtaattacttccgacatatgcgatcctgcgggacagaatatcggtgtttacggtgatgaccggaatgttcatttctgtgaggcggtcgatttctgcggcaatatataaagaattgaatggtgcgataactaatccgttgatgccttccgcaagcagtgcttccatggtattaaattgttcggtctcatcaaatggaacctgacggataagaacggtgaaattataggcagataattcttttgccttggcatttacgccttcaaggacttcactgaaaaaaggattggaatcgggaaataaaataacaccgattttcagattctttttctgtgcagcaagcatcagtcctgctttgttgggtttatagtttaatttttctgcaatttcacgtacacgggctgcagtattggcattgacggaaccgcggttgttcagtacacggtcaaccgtaccgcgtgaaacacctgccagttcagcaatctgttttatagtggccatgtcgttcccccttgttgaatttttcctgaataactcttacaagggtagcattgataaggtaaaatgtcaattgaaatacagaaaatgtgtgcgtgcacgacgagagtggggaaagttactgtacgctttccacaaaataagtgcaacctgtttggaagaaatcacgaaaaagagaaaaaatttcggaaaacagttgaaaatatcagcgcatcgttgtaggatatgagtagaacgtgcacgagcacaaaattaacatttcagaattgagggttatcatgaattacataggaattgatctgggaacttctgctgttaaacttcttttgatggagggcagtggaaaaattttaaagatcgtcagtcgtgaatatccaatctgttttccaaaaccgggatggtcggagcagaatccgtatgactggtttacacagtcaatggatggactgaaggaattgctggatggtacagacaggagtctggtagccggcatcagctttggcggacagatgcatggacttgtagcactggacgataaggatgaagtgattcgtccggcaattctctggaacgacggaaggacgacaaaagagtgcgattatttaaatcaggtaattgggaaggaacgtctttctgcatacacagccaatatttcatttaccggatttactgcgccgaaagtactctggatgaaaaacaatgaaccggagaattttgcaaagattcataaaattatgctgccaaaggattatctggcatttcgcctgagcggcaattacagtacggatgtatcggatgcgtccggaacactgttctttgatgtaaagaatcgctgctggtcagaagaaatgtgtgagatctgcagtattaaaacaagctggcttccaaaagtatacgaaagttatgaggaagttggaacgctgcttccggaactggcgaaggaactcggcgtatcggatcaggtaaaaattgtagccggagccggagacaatgcggcagcagctgtgggaaccggaaccgttggagatggtgcatgtaacatttctttgggaacgagcggaaccgtatttatttcttccgataaattcggagtggacgaaaataatgcactgcattcgttcgaccatgcggatggaagttatcatctgatgggctgcatgctttccgcagcatcctgtaataaatggtggatggatgatattatcggcacaaaggattatggcgcagaacaggaaaatattacgaagcttggagaaaaccatgtatttttccttccatatctgatgggggagcggtctccgcacaatgatccgaatgcaagaggtacttttatcggtctgaccatggatactaccagagcggatatgacacaggcggtactcgaaggtgtggcatttgccttaagagattcttttgaggtggcacgttcactcggcattcatattgcccgtacccgtatttgcggtggaggagcaaagagtccgctgtggaagaagattgtggcaaatgtgctcaatattccggtagatattccggaaaatgaacagggaccgtcaatgggtggcgcaatgcttgcagcagtagcctgtggagaatacccgaccgtccgcgatgcagcagaggcaattgtaaaactgaccgatacggtagaaccggaaccggagcttgcagcaaaatatgaagagcgttatcagaagttccgtaacatttatccggcatgcagggatctgtttttggaacttgcaaaataaaatcatatcatcgtatctaacaaaaatttaaaatgattacatacaacaaggaggcaaaatcatgattaatattccagaagtaaaagtaggtatcgttgcagtcagccgtgactgtttcccggagtctctttccgtaaaccgcagaaaggcgctgatcaaagcatatacagacaagtatgatgcaaaggatatttatgagtgtccggtctgcatcgtagagagtgaaattcatatggagcaggcgctggcagatattaaagcagcaggatgcaatgcgctgtgtgtataccttggaaacttcggaccggaaatttccgagaccatgcttgcaaaatattttgatggaccaaagatgtttgttgcagcagcagaggagtcccagaacaatctggttcagggacgcggagatgcatactgcggtatgttaaatgcaagttacaacttaaaacttcgcaatgtcggtgcttacattccggaatatccggttggagatgcagaggattgcgcagatatgattcacgactttttaccgattgcaagagcagtggaaggacttgcaaacttaaaaatcatttcctttggaccaagaccaatgaatttccttgcatgcaatgctccaatccagcagctttataatctgggtgtggaaattgaggaaaattcagagctggatctgtttgaggcattcaacaaccacgcaggagataagcgtattccggaggttgttgcagatatgaaagcagaactcggtgagggaaacaaaaagccggagattttagagaaacttgcacagtatgaactgacactgcttgactggattgaggcgcacaaaggttcccgcaaatatgttgcaattgcaggaaaatgctggccggcattccagacacagtttggatttgttccgtgctatgtcaacagccgtctgaccggaagaggtattccggtatcctgcgaggtagatatttacggcgcactgagtgagtttatcggcacctgcgtgagcgaggatgctgtcacactgctcgacatcaataactctgttccgaaggatatgtacaaagagtcgatcgagggcaagtttgactatacacataaagatacatttatgggattccattgtggcaatacctgttcaaagaagctggcatcctgtgagatgaaaaaccagatgatcatggcaagaagccttcctgtcgaagtaacaaacggtacccttgagggagatattgcaccgggcgatatcacattctaccgcctgcagtccacttccgacaataagctgcgcgcgtatgtggcacagggagaagtccttccggttgcaacccgttcgttcggaagcattggcgtatttgccattcatgagatgggacgtttctaccgtcacgttctgatcgagaagaattatccgcatcacggagcggttgcattcggacattacggaaaggctctgtttgaggtatttaagtatattggggttccgatggaggacatcaattacaaccagccggcatctctgccttatccgacggagaatccgttcgcataaagaaaaataatatgggaataagcaccagcttgagcctgtagatgtctgcaggttaagctggtgctttttaaatgggagtttcatcccaaagatacccagtgaaacaggaaaactaaaatcatttggcaggtaattcatccggcagcaatacagaaaatgacaacagtacaaagtaaaaattcagattttcaaaaaaagaaaaagtatggtattataaaaccggcatcacggatgccggttctataataaaaatctgaggtgattgtacaatgaaacaggaaaattatatacgtggcatgataatgattattttgtcggcattcttttttgcgtgtatgaatgtgagtgtgcggctggcgggagatctgtcgtccgtacagaaaagtttttttcggaatctggtagctgcattttttgcggcaattattcttatcaaaaatcatacagcacctaaggtggaaaaaacacagtggggttcactgtttttacgctgtgcatttgggacacttggaattctttgtaatttctacgcgattgatcacctgctggtggcagatgcttctattttaaataaattatctcccttttttgcaattattttttccttcctgttattaaaagaaaagataaaaccagctcaggcaatgtgcgttatactggcatttgtcggctgtttgtttgtggtaaaaccggggtttgaaaatgcacatctgatccctgcgcttattggcgtatgcggaggactgggtgcaggaatcgcatatacaatggtgcggaagatgggtacacacggagtaaagggaccggtcattgtgttttatttttcctgcttttcctgtattattgtgataccgtggatcgtatttcattatcagccgatgtcactgcggcagttgttgacgctgcttcttgcgggactttttgcagcgggaggacagtttacgatcaccgcagcatatacctatgcacccgctggaaaaatttctatttttgattattcacagattatttttgcaacattacttggatttcttttattcgcggagattccggatcgatacagtctgataggatatggattgatcattctggcttcactgggaaattttctgtataactggaaacacaaagattaaaggagtattcacatgtcgattatttcatttcggtgtcatacaaccattcatctggcaccattggtaaatcaggaaaccattcatcaggatatggataggggacagcagcttatgtcaaggatcaatcagggaatccttagggagataaagcccaaaaacccactggttgaatggtattactggaaggacaaacacacagtttcggatgtcacagagcatagtttgtttaagatggcgcaggggatgctgtcccccgtggaaaatgataattaccggttggaagagatcgaagaattaaataatgcatgggccgtttatgataaaaaactgaacacattttttgcgtttgacccggcaattacgacattgcaaaaagatgagaagcgaaaccgtgtgctggtagtctgtgaagacaaggaacgcgggctgattgatgttattgaagcgggagctctgctgcttgagtgtctgcgtgcatttacagggatagaagaactttgctttcttccgctcaacccggactactatatatggacaggaacggtgactgggattgacggattgaagatgcgcagtaatggatatgccggtacctggctgcttctgcaaagtgaaagccaggtgaagaaattgcggatgcttgcaaccatttacagtatggattatccgaatctggtagattcggatgaactggcacgcagactggcaaaggaggaagccgcagggcagtgcatccgaagcaggcatgggatcgtgctgtttacggaagagggccttgtgtatatggatggaacaaatccggacaatgactgggaactgaagtatccaatttatgagaatgactgttattatgagatgctgagatttgcttaccggaaacaggtatccggggaactggaaaattactgtgcatggaaagcctggctgaacaggaattttacttgacatctgaaagaatcattactatacttaaaaccaaaggtgaaaaacgaagacgaagacagtaactgtgataggaaagtcaaagagagttggaacaggtgagagccaatacgagtaatatgacagtgaaaatcacttccgagttgcggatcgaaatcccaggagagtagagttcgacgtatttccagcgttatgggaacgaagtatgcaaatcctttttgaatacgggatttaagtacatggtaatcaggtggtataacgtgaccccgcgtcctaattactggacgtggggattttttatttcagaatcataaatgcaggaggaaaatatgtacaacaaagtagataccaatatgaactttgtcgatcgcgaaaaagaaacggaaaaattctggcgcgaaaatgatatcttcaaaaaatccatggagaaccgtaaggaaggcgagacttacacattttatgacggaccgcctacggcaaacggaaaaccacatatcggacatgtagagacacgtaccatcaaggatatgattccaagattccagaccatgaaaggaaagtacgttccacggaaagccggatgggatactcacggtcttccggtagaaatcgaagtggagaaacttcttggactggatggaaaggatcagatcgaagcatatggtcttgagccattcatcaaaaagtgtaaagaatccgtctggaaatacaagggtatgtgggaagatttctcaaatacggtaggtttctgggctgatatggacaatccatacgttacctatgatgacaatttcattgaatccgagtggtgggcattaaaagagatctggaacaaaggacttctctacaagggattcaagatcgtgccttactgtcctcggtgtgggactccgctttccgcacaggaagttgcacagggatataaattagtaaaagaaaaatctgcagtcgtccgttttaaggttgccggagaggatgcgtattttctggcatggaccacaactccgtggacactgccaagtaacgtggcactctgtgtaaacccgaatgatacttatattaaggtaaaagctgtggacggctacacatattatctggcagaggcactggcagacaaggtactttctccactgttatccaaagaggacaaagaggcaggaaagaaagcttacgaagtgctggaaacctgcaagggaaaggatcttgagtacaaagaatatgagccgctttatgcctgtgcaaaggaactggcagataagcagggaaagaaaggattctttgtcacctgtgatacttatgttaccatgtccgatggtaccggaatcgttcatatcgcaccggcatttggtgaggatgatgccaatgtcggaagaaactatgaccttccgttcgtacagtttgtaaacggaaaaggagagctgaccgaggagacaccgtttgccggtatgtgggtaaaagatgccgatccggaagtattaaaggatttgagtgcaagaaagcagctttttgatgcaccgaagtttgaacatgagtatccacactgctggagatgtgacaagcctctgatctactatgcaagagagtcctggtacatcaaggagaccgcggtaaaggatgatctgatccgaaataataatacggtcaactggattccggaatctatcggttccggccgtttcggaaactggctggagaacattcaggactgggcaatttcccgtaaccgttactggggtaccccacttaatatctgggagtgcgcgtgcggacacagggagtgcatcggcagccgtgccgaactggcagaaaaggctggtgatccaaaggcggcagaggtagaacttcacagaccatacattgacgccgttacgatcaagtgtccggagtgtggtaaggatatgcatcgtgtaccggaagtattagactgctggtttgattccggagcgatgccgtttgcacagcatcattatccatttgaaaacaaagaagtgtttgagcagcagttccctgcaaagtttatctccgaggctgtggatcagaccagaggatggttccattccctgatggcagagtcgacactgcttttcaacaaagcaccttatgagaacgtcatcgtgctcggacatgtacaggatgaaaacggacagaagatgtccaagtccaagggaaatgccgtagatccgtttgatgccctgcagacatacggcgcagacgctatccgctggtatttctatacggcatccgcaccatggattccaaagagattctccggcaagcttgtgcttgagggccagcgtaagtttatgggaacgctctggaatacctatgcgttcttcgtactttatgcaaatattgaccagtttgacgctacaaaatacaagctggagtatgacaaattatcggttatggataagtggctgctttctaagctcaattctgcagtagctggtgtggatgaaagtctttctaattataagattccggaagctgcaaaatatctgcaggagtttgtcgatgatatgagtaactggtatgtccgccgctcccgtgagcgtttctgggcaaaaggcatggagcaggataagatcaatgcttatatgacattgtataccgcacttgttacaatcagcaaagcggcagcaccgatgattccatttatgacagaagatatttatcgcaatctggtatgctccatcgatccgtcagcaccggaaagtattcatctgtgtgacttcccggttgtggatgaaaagctgatcgacaaagatctcgaaaccgcaatggatgaggtattaaagattgttgttatgggacgtgcgtgccgtaacagtgccaatatcaagaaccgtcagccgatcggacagatgtatatcaaggcaccggaagcactgggtgatttttataaagagattattgccgatgagttgaatgtcaaaaatgtggcatttaccgatgatgtttcttcttatacagattatcagttcaagccgcagcttcgtacggttggtccgaaatatggtaagtatttaaaacagattcaggctgccctgtcagaacttgacggaaatgctgcaatgaaagaattaaaagagaacggatgtctgaaacttgacagtgtaagttccgaggttgtattattggaggaggatcttctgattaccatgacacaggccgaaggctttgtgaccgagggggataacaatgtgacagttgttatggatacaagactgacaccggaattgatcgaagaaggttttgtacgtgaactgatcagtaagattcagaccatgcgtaaagaggctggttttgaagttatggatcatattgctgtttcctatacagcagacgagaaggtaactggtattttcaataaatacggagaaaagatccagacagaggtacttgcaaatgctatcactgcaggcacacttgccggatatcagaaagaatggagcattaacggtgagaaggttacgctggcagtggaaaaacaatagtgtcacgcaaaccaggcacagaggaggacttttgatgcgagacaaagtgtttagtaaaaaggagtttattgcttccgtgacagaaaatgtcaagacgatgtatcgtaagacattgaaagaagcgacacagcaggagatttatcaggctgtttcactggctgttaaggatgttgtcatggatgaatggatggcaacacagcaggtcattgaaaaagatgaccctaagatattgtattatatgtccatggagtttctgatgggcagggcactgggaaataatctgattaatctgggggcttatggggaagtaaaagaagcacttgaagagattggactggatttgagtgtcattgaagaccaggagccggatccggctcttggaaatggcggacttggccggctggcagcatgttttatggattctcttgctactctgggctatgccgcatatggatgtggaatccgttaccgctacggtatgttcaagcagcagattattgatggatttcaggtcgaagtaccggataactggttaaaggatggatatccgtttgaacttcgcagaccggaatactgctacgagatcaagtttggtggtcatgtggaagaaaccgcaggggaggacggaaatctgcactttgagcaggtagggtatcagtctgttcttgcaattccttatgatatgccgatcgttggatacggcaaccatgtggtagattccctgatgatctgggatgcacagccgaaggaagagttttcactggattcctttgaccgtggagattacgatcaggcagtggagcaggaaaatcttgcccgcaacctggtagaggtgctgtatccgaacgacaatcacgtaaaaggaaaggaactgcgcttaaaacagcagtatttctttgtttccgcaagtatccagcgtgcgctggagcgttttaagaaacatcacaatgatctgcatgatctgccaaagaaggtaacgttccagatgaatgatacccatccgacggttgctgttgcagaactgatgcgaatccttctggatgaggaaggcatgtcatgggatgaggcatgggagatcacaacacactgtgtagcttataccaaccataccatcatggcagaggcacttgaaaagtggccgatcgacatcttccagagactgcttccgcgtgtatatcagatcgtggatgagatcaaccgccgttttgtagaagagatccgtgcaaaatatccagataatgaggagaaggtgcgcaagatggcaattctctacgacggacaggtgaagatggcaaatcttgcaattgttgccggatattctgtcaacggtgtggcaagactgcatacagagattcttgagaagcaggaacttcgtgatttctatgaactgtttccggagaaatttaacaataaaaccaacggtatcacacagagacgtttccttgcacatggaaatccactgcttgcagactgggtaacaaagcatgtcggaaaagactggatcacaagtcttgcgaaggtcgaggatctgacaaaatatgcaaccgatccgaaagcacagcaggaatttctggagatcaaaaagcagaataagatccgtctggcaaaatatatcaaggagcacaatggtattgaagtcgatccggattctatctttgatgtacaggttaagagactgcatgagtataagagacagcttatgaatatcctgcatgtgatgtatctgtacaaccagatcaaggaaaatccgggcatggatttctatccgagaacttttatcttcggagcaaaggctgcagccggatatcgtacggcaaagaagaccatcaagctgattaacactgttgcggatgtaatcaataatgatccatccatcaacggaaagatcaaggttgtgttcattgaggactaccgtgtatccattgcagagtggatttttgcggcagcagatgtcagcgaacagatttccacagcaagtaaagaggcatccggaaccggaaacatgaagtttatgttaaatggtgcgattacacttggaaccatggacggagcgaatgttgagatgtacgaggaagtcggtgcagacaatatctttatctttggtatgagcgcagatgaggttatcgcacatgagcagcatcatgattacaacccatatgatatctacaacaacgatgaggatatcaggaaagttgtcaaccagctggtagacggaacatactcccacaatgaccgtgaactgttccgtgaactgtacaactcactgttaaacccacagcagggacaggtggcagaccgctactttatccttgcagatttccgtgcatatgcaaatgcacagaagaagatcggtgcttattacaccaacaagagtgcgtgggcaaagtctgcaattttaaatattgcgcacagtggtaaattctcttctgacagaaccattcaggaatatgtcgatgatatctggaaactggataagattgaagtgaatacggaaggctgttaatcgcttggatggcagtaaaaaaggcgggaacctggttgcggtttccgcctttttcgcgtagaaatactggtcaaaaatttcctttgtggtaacattttcaggatcagtttgacgtagataaaagaaatggtaaaataaaaatggaggagaatatcgatgaaaattgcaatatgtgatgatgaaaaacattactgcaaacagatacaggaatgtgtggaaatatatttggacaagcatcatatatacgggaaaacagaaatttttatggatggaaatgccttgttagaaagaggtatgctggcggaatttgatgctttgtttctagatgtggaatttggtggaaaagcgcagggaatgaaaattgcaagagaggtgcatcagagaaatgcaatgcttccgattgtatttgtgtcggcatttattaaatattccgtagaaggatatcgcgtaaatgcgctacgttatcttttgaaaaatgcaaaagatttgcagaaagaaatagaagaaagcatggataccgttctttccgtgtatacgcagagacaaaagaaaaaaacatttcgttttcggggggagaccgtaacgcttttactggatcagattatgtatattgaaagcaaagctcatcagctgtttttttatttgtgcgatgatacctgtcgatgtatgggaaaacggacacttgatgaaatgcagagagaactgacggaggatgaaggaagatttttgcgtatccataaaagttttttggtgaatatgaacgacatcagtacgctcaaacgttatcaggttcagttattttcgggaaaacagctgccgattccgcgagagcgttatgcagtggtggaaatgcagtatgaggagtggaaaaacagaaatgattgattttgtggaaaatctgttttttattttaattgagacgatatgttgctgtctgtattttcaaacgttttcaaaatttcggtttacaaagaaaatacaaatcttgcaatttattgggctgacagggtgtatgacagcggtaatctatctttttgcaacaattcctttttggaaaatgccaacagtctggtttttatttgcggtatcgatgtatggaatgtttcaaatgaaatttttcgaagcattgggaatgggagctttgtactatgcccttcttctggttgtggatgtattggcatatgcctgtaatgacattttgcaatttcgtatgggaggggaaacaaaagtgtatgggtggaaagcatggctgattgcattgcttgggaaaatgttcttatttataattattcttttggtaagacgaatattcgggaaatcggcagtagaaacactctcgaagagagaatggataaagtttctggtatttccgatattcaccatttttatgatcgcatggatgctggtggtcgttcagagttcacaggcgggatctggaaaaatccctatagtgttggcattttcactggtaggactcaatgtttttatttatggattgctctatgatatccttcagaaagaagtcaggacaagagaatatatggtgtccatggcgaaagcagagggaaaatacaattatatcaaaagcagacggcttttatacatgattaccagaatcagatgcagtgtgtcagaacattgctgatgaaaaaaaattacaaggaggcagagcagtatttggagcagatgtgtaatgtgggtgcggatgtatggaatgttattgatacgaatcatatgatcgtaaatgcggttctcaacgcaaaatatcaggaagcacaggaaagtggaattggagttacgataaagattaatgatttatctggctggaggatggcttacaatgatgtgacgatattgcttgcaaatttgcttgataatgcaattgaagcctgcaaattatgcgaagacaaaaagcatatctggtttaaatgtgttcaggaatcgggaaaaattattttatccgtaaaaaatacatattgcgaaatgaataggaaaaagaaagagggactacacggaataggattaaaaaatgtagaacatgtgatcacatcttatggtggaaattacagtataaaaaaaatacagggaaaatttattgtgactattttattctggatggaagaatagagattcaagcagctgaaaagagaacttttacagatattatgtaagggttctcttttttgttgtgataaatggtcgaattttgtaccagtaatgctgttttttgttcataggcttgcttggagaaaattattcttataatgtaaaaatggaggtagaatataaagtttaaataatagtttagaaaggaagtgaaaaataaaatgttgaagctgtcagaaaaaacattaaaagtgctttggaaaattgctacaagagaagtggataagcagaaattatcatggccgccactttgtgcgggaatttatcatcaacctaaaagaccaaagaaaaaataaaaagataaggagtaaagtttatgaaaataaaatggaaacgagcagtgagcattatacttgtaatgacacttatggtaactttcgcccaatggaaggtttacgcggatgaagaaaaagaaacgacagagatagttgaaaataatttggaagttgtatatcaggagaaagaatataagataatcattagtttgaaagaacattgggatagtggatataatgctaatgtaaaaattgaaaatataggtgaggaaacaattgaaaactggtatttgcagtgggtgtatgaagaagatattacaaatatctggaatgctgaagtgaagtcacatcaagatgcaaactatataattaaaaatgttacatggaatcaggatattgaatcaggaaaatcaattgaatttggttttagtggaaataaaagttttacaggctttccaaaagaatgtaaactggttggcgatagctcggaagtgaaaaaagatgattatacaattcaatatcagttggatagtgattggggagatggctttacagggagagttttaattacaaacaatacagagcagacactagaagattgggtattggaaatggattttgcgcgtcaaattacaaatatttgggatggaaaaatcaaattacatgaagaaaatcattatataattcaaaatgctggatataatagtaatataatggcggggcaaactatttcatttggatttaatggaataaatggaaaaaaggaaatggagccggaagcatatcatttgtattcatataatgatgaagctgaacaatataagacgattcattttgaacttaatattgatccggatggagttacgaatataccagaggatcaaattgtggaaacaggtaaatatatgcaggaaccagaacaaaatccaaaaaaagatggatatgtttttttgggatggagtacagatgtaaatggagatgaatattttattccggatgaaacacctattgtaaaagatttagtgctttatgcagattggtttaattatatagatgaaacagatacagataaagatggtttaagtgatgagttagagagaatattagaaacagatccattgaaagaagatacagatggagatggaataaatgatagaatagaaattgatcagttgcgaacagatccgacaatgtcggatagtgatcaaaatggcatagaagatggggaagaggatagtgatgaagatggtttaaaaaataaagaggaattggagattggaacagatccgatgaatgaggataccgatggggatggattgaatgattttgaagaaataaatacatatgggacagatccagtgaatgaggactctgatggggatgaagtttcagataaaaaagaaattgaaatagggacagatccactgaaaaaagaagaaagttttcatgttacagaacaagcggaaggtgatggaaaagtgcaggcatctgttacgattgatttaaatggtgaacaggttgaaacacttacggtaaaaccaaccggaactgaattcctttttccaaaagaaatgcctggatacattggaaatgcatatgaattttctgtagatggaacgtttgattctgcaaagttgtcttttacatttgacgaggaattattaaaagataaggattttgacccgataatttattattataacgaaaacataggaatggaggaaatgccaacatccattcatggaaatacggcgacaaccgaaacaacacatttttcaaaatatattttattaaacaggaaagagtatgaaaaatcatttacttggattgatagttctccaatcgatgtgtataataatgctgaagttgtttttgttatggatgatacagggagcatgaagacaaatgataaatcttttaaacgtctttcagcagcaaagagtatgatagaaaatctaccggattcctgtaagataggtatagtacgatttagtaatgaatctaagaaactaacaaagaagcttgtgacaaataaaacagaagccgaaaaatatcttactaccgattatttttcttcgagtggcagtacagaaatgtataaagcggtaaaaaatacattttcactatatgagtcaagtgatataaaaacacttaagatcatgatagtgcttacggatagtgcttcaaaaaatttagaagagcatgatgtaaccgtacagcaggcaaaagaaaaagatatccgaatatataccgttgggcttggaactgcaacaaattattttaaaaaatatctaaaaccattggctgaagatacagatggagcattttatatggcaacggatgctacgaagataaaggatgtatttgaaaaatgtaatcaaagaattgatttacagatggatagtgatggagatggattatgtgattatgcagaagataatttgactttgtttaacggggtaaaaataacaacggatagatacaaagctgatagtgatgaggatggattaagcgatggcgaagaaatacttgtaacaagaccacaatattgcgataatgggaaaaaaatgagacttgtattattggggaaatcaaatccatgtagtagtgatagtgatggagatggactgaatgatggaagagtatcgtttaaaaatggaaatattattgcaccgaaagatccagatcctaataatgcaaatgaaccgatgggattatggaatgcgcatattgaccaacagaaagtaagagtaagcagaaaatatgaatttgaacatgattattcaaagaaacagctgcaaaaatatataaataatggaatgaagaaaggaaccaccaagaagacggtacaccaaattgtcgaatgggcattggatatgagaaataccgtaaaccaaaatgaaaaaaagattaagtgctttgcaaagtttttaaaaagatttacaagtggaaaggaagcaacggaggcgggggcagctattttaaattttgtaaaagatacagatgatgaggcatatcattcccaggtagaaacttggcaaagaagttttggatataatgtgttttatgatgaagtattccggattggaacaaagatgaatgaaaaagattttccattcaaagtaggaaatgaagagtatgcgctttggatgtggaaagggaattactggaatttgcatagtggagcagaaatagggttgtacaaatatgatagaacccatgctggaacaaaacattatgatgccattgattttgaagtaccaatgcgtttgagtttgtatcgatattctaacaatgggaagcagatcgatacgatatttaactggtatccatatggtggtcaatggtggattacaggatttagtggagataattctcaattcagaaatacaaattgtaataacatggcagctattgggtatgttgatttatcaaaacatatagatatatataaagggattaggaatgctggcagaaattataaaggggatagaaagaccgcgaataataagtatttgatttttgatgataaaaattatttgatttggatatattggtacgaaggaattaaataaataatgcccaaaaaacatttataataatactggtaatggaactatgtactgctctggataatggaaggatggtaggaaaatgatgaaaaaaaaaatgatcgtaaatgacattttatgtttattcagttgtttttttttgatgggatgtaatgcaattaaagaagataatacaaaggtatacgttgattcttatagccaaacagctctgcaacaggctgacatcattatggatggcattcagtcagaaaattgcgaagaaatagcagatattttttgcacttatatcaaaaaaaatcatccggagctgcaaacagatataaaagcatggatgaaatatattgatggcaatattatatcttatgatccgccaacaacagaaagaggatcgttaaataccggggaatcaggagtggaaatgttggttatggaagctgatattgataatgtgaagacggataccggaaaaacttactgcataggtatggggtcatattctgtatttaaaaatcattcagattgcgtaggagtgacagatttattaattcgtgatttggatgcagaaaaagaaaacaaagaggattcgcaagttagagtggaatatgatgatatatggacgatagaatatggaaaatgaaataaagcggttagaaaaaaatagaagtgtcacgatagtagtaatgctggtaatcatgctggcaatcgtattgagtgcatgcacagtttcggcaggtggggaaccgcatgtaaaatccaaaagtgaaaaagcaattgagcaggcaaaaacaatactacaggggataaaatccggtgatgcagagaaaatagcagatcagtttagtccgattgcgaaagaaaaacatccggaattagaaaatgatatcaaaaaatggatgggttttttagacggagaaattatatcctatggtgaacctgttcgtgattttggggatgcaacatgggatgaagatggatatattatatggggaggaagtatagaaattgataatgtaaaaaccgatacagggaaaacatatgagattgtttatggggtgtatgctacagtaagggatcatccagaatatgaaggggtgacagatttacttgtaattgataccaaaaaacaagaaaaggcaaatttggaagataaagacatagatctttctgatgcgcagaaaagcgtgggctatgatgatgtttattgggagtggtagacaaaggaacagtaggagaaaaagttatggcgtttgtgacaatgatttttgcatacatggtaatagctggagtaattgcaatggtgattgccgggacaatcagcacgataggtcttattgtcttgattatatcgttgattcgacggcacagggctaaagtccggggagaaacgccaaaaaaatttggtttgattacagggtggattttgtttttgctgccaatatttgtagttattagttttatagtctattggtttgtttgaatattgagttggtggaagtggagataatgttagatcaaataattaaaaattgtctggatcaaatgcaggaaaaaaatctgattatggaagacaacagggaatattatcagtatgctatggaactattggtagaagaaagtttgacagttggaacaatacttgtggtaattatatgtatgcaggaatttgtgaatggggtgatttttcttatttcatttttggctttacgaagaagaactggtggttttcatatgaagacgtttaaagcatgctacgtggcaaccatcgggacatttataggtgttttgcttgtgaaaaatattatgtatacatattcaaaattgttgcttgtttttacctgtatagcggctagttatcttttgattgtaggtacgatgaatcatcctaatatagatatggataaaatagaattgttggcaagtaaaaaatgtgccagaatggtatgtataatagaattgttaatgattatagttggaatgcaaattagaaattttgaagaaatttctataatgatatcattggcaattatattatgctctgtttctatgaaacttgcgcagcttgtgagacaaaaaatataacattgcggagaaaataatgggaattgtattaactaagttagtgcgattcccattatctgatagtttgtgaaaactaaggaatgccgtgtatggaatgagagagcaactaattaaccgtggttagagccgcatacttgatttatggaagttttaaagcctttctgtgggaaatgatagtacatcatcatcaataataattaacggatacattaattgttgtctggtcaaaaattccctttgtatttaaaatgattttctgtgtagcatcgttaagcaacagatttgtatcttccacacagcggttttcgacagtatagacatgtctgccaatatggaacggatcaaaggtgcagacaaagattacaaaactctgttttaactgtgtgttcaatgttgtaaactgtattggaatcgtcctcaacatagacatctagtcggatgcttttggcatcgagagaaagattgatcgttttctggtcttgtgggtactcaatgcgcgaaatcttaatattcagtattgtttcccaaaacggtttgcagtactttggattgcgcatgataatgccaaacataaaatcatcactaatggtaagaacttcgaactttttgctcatatgcatcttcttctcctttgtagtggtggagaggaaaaggtgtcatatagaggctgtttttctatcagaattgttacatggaagtctccagctttcaatatctgaatagttacaaaacaataataaaataacaactgaatctttgttctgcacgaaatttctctccaatatctaattagtacacatggaaaaatggatgaaatatccaatgaaatgcagtcaaatataaaaagactgcacattcgatatgtgtaaagaaaatatagtatgtggaaggcatatatacaataggaaaatagaactaaaaaggggctgtaaaataagtccctaatataagaaacgccaattccggcaaatgtcggttttggcgtttctttgtattaacttttctatttctaagcaagtctgcatctttgggtataaaaaatggtgcatttaataaagctcggctaatcacgcccgcttaagttttatgcaactttcgtctgtcgttgctttttgttgtgatatttataaagattgaatccacatgaaatcagtgtaagctcgagaattacatttttctcgcctcttcgcaataatcttttatacgctttatcccactttaatacaccaaaagttccctccgattgaatacttcggttcattctcaagagagcaccatgtatggattcaagattttgcagcacttcctgatggatagcagttaattcctgattcattcggatcgttcggtttttatgtgctctcggacaacattcttgtttatgctgacacccttcacaagattcacattcgtataattcttccgttcttccatatttattatatttcacatgctgtgttctcttgaagaggaattttcgaccgtttggacataagagatttccatctgcatcttttacaaagtttacagcacgatacggattctcatgatactttttgtccgtcgtttcttttttgtacatggtaaatttcatgtatttttccatgccgtgttcttcacaataaagataattattgtaagaaccgtatccggcatcagcaaccggatatttcggatagtgaccatatgtgcgattgaatttttccatcaaaggaacaaagcattccatatcggatgcatatggttttacgtcgattacagctatgtattcatcacagatggctgtctgtaggttgtatgccggaagtagctgatcgtttcccatgtaatcacgctttaaacgcatgaaagttgcatcatgatctgttttggaataactgtttctttcttctccacaggtctcgatatgatatgcataggatttcaaacgttccagatattcatgcaattcttcgtattgtttttgtcgaatgctttttctatgaccacgtccggaaacgaaagaagtttcatccagtccggttgtttctttgtacatcgtaagtaattcagagacatagtcaaccgcgtacgcttcacgcttttcaaattttattccgagatatccaagtacttcccgattcatagcatcaatcaagagtgaaatcttgtcaaagactttctgccggtttttcacacacgattttttccatacccaggtatatcgattggcatttgcctcaatttttgtcccgtcaatgtatgtatgctgcagatccacgtgatctttggcaaaaatatatgaattaatgtcttcaaatatctgctcgatagaatcggttagttcgtttcggattaagtttccaaatgtagcaaaagaaggcgttttcatgccatcaagaagatacatgtaacgaatgtcattacggcagagcttttctatttcccgtaaggagcagatgccattttccataaaggcaaaaagtattactttaaggagtttttgagcatcacatcttgggcgacctgttttatagcctttctctacaaaatatctggataggtcaatgtgatccataacctcacaaaaagtgtataccggatcggaaatatcgatcaatttttcgatttctaatggtaatttcagctgacgcatagtataattaccattggtattgttatttagtagcataattaattataccaaaaaatcgctcagacctcacggtctgggcgatttttctgtcaggggagtttttttacagcccctttttttaggaaagaaatgtatgcagttcgttcaggcgtgcatcaaagtcggaaatccccagatcatacaactcctgttctaacttttcatcacgcgcgtaggtactcatctttaattctttcgaaggtgcaaagacaagcgcttttccagcggattcctgtttttttacatcggcaatattctggcggtacatcagatgccggttgtcgagggcttttatggtctgtggatatttgcgcagggcatgccggtaaatgtgccggaagccttccggctgctttacaaaactgcggggtttgcttaagattacaaccacacggtcacatcccttggcaaacgcgcgctcgatcggaacggaatccgataatccaccatcaaaatacgtctcattatggaaagaaatcggacggcacataacgggcagggcacagcttgccatgatggcacggtagtcatcctgtttcatatcatctttggtaaaatacaccggttttccggttgcagcatcggttgcaacaagctcgaactcggccggattttccacgatggcaggataatcgatcgggtcagctccatcggagttggtcagtgtctgataaatatactgaagaccgaaaaactgtccggtgcgcagcagatttttgacgcccatataaccaggttcgttcagatggtctacataaaaacgaagattgcgcccgcgttgtccggcgagatagcttgctgtgtttgcagatccggccgatacgccgatgcagtaatcgaatgtaatgtgttcatctaaaaagcggtcaagaatgcctgcgctgtaggcacatttcatgccgccgccttctactacaagtcctgtcttcatgtctgggatactccttttgcctgaaattagcattattgtagcactttttttctttttgtcaaatttttaacaatatgtgtttgtttttccgcaaccgtttaagtggtgccgggacatttgaaaaaagtgattggctgacaattccttagaatgggacagcccggaaggcagagatattggattttttgatatgagatatgatttgacgaatggggagattgaggaaggtatgggataatatttaaaaataataatatcctttcgtgaagaaagtttcataaaagctaagaaagttttcaataaagttgtggaatttgtttctcatggaagttcatctcctttctgtttacgctgtcattataaaacacgaaaggggatattacttgccaaaataaaaaaataattggacaaaaattgcaaaaagcagagataccgcttctctgctttttgcatttttcttatatgtttttacgatattcagaaggtgacagtccttttgccttttgaaaaatgcggctgaaatacagtggattatcatatccgacaatttgtgcgatctcattgatattgtattgtgtattttgaagcagtgcttcggcattatatattcttttttgcagaatgaattgctttggcgtgattccggcatataatctgaaattacggataaaccaactggcactgacatgattttgttcggcatagtcatcaatgctgattggttcattgtaatgctcactgaaataagaaattgctttgtctatttcctcagcagcatgggagttcactgtgttgacagaaaatttaaagtggcgttgtagttttataaaaatttgtcttaaatacatttcaagcatttcagaatagctatcctgacacatttgtaattcttttatcatggcacggaaaagatactgatattccgaaccggaaccacagtggaacacccttttatcatttgtcaatccataggaacggagcagattggtgacattgtttcctgtaaaatgaacccagtaaacctccgtctggtctttggcatagtattcatatttctggggttctcttgggcggtataaaaccatatgaccagcatgaacaatcgtttcttcctcatcgttgtcaaaatgaaaatgagctttcccggcagcaataaagatcaactgaaaatcaactctgccacgtggtctccaggtgggaagtttagggtgcgtatataacttgtaagtcccacacatggttacgacaagtggcttggatttatcttttctgtcaattgttgagttattcagatatgcattattggtatacatttgagacccccatatgataattgaaaatgttcatgaaataataatctgaaatacataaatttatgtttggctcatgatgcaattttatcattttatgcatgtcttgtccatttggattttaaacgtttgaaataatggtattttttgtataaattaacgtgctggaaaatgaaagccaataaaagtacatgtcaaaaataacaaaagaagggaataaagaaaatggtttttgttaattatactgttttgtgcatgttttgtgtaatttatgatatggtttttgacatcagtttttatatactatctataagaaagttgtgggaacaaaaataaggatcatcgaaaggagcagtttcacatggaagaaaagaaatacctgaaatggtataacaaggtggggtatggaaccggagatctggcaggaaatgtcgtgtatgcatttctttcctcatttgtaatgttgtatctgacaaatacggtagggttaaatccgggagttgtcggaacattgatcatggtatcaaaattattcgacggtgtcagtgatatgttttttggtacattgattgacaaaacaaagagcagacttggaaaagcaagaccgtggatgctttatgcatatattggctgtgcggtaacgcttgtggcgaactttgcaataccggaaagtcttggaaaaacagcacagtatgcatggttttttattgcatatactttgctgaatgcagtattttttactgcaaacaatattgcctatgcatcactggttacgttttgtacaaaaaatagcaaagaacgggtagaaatggggtcgttccgttttatttttgcgtttttaacaagtctgatcattcaatctatcaccgttcagtttgtaagaatggcaggcggtggagctgctgcatggagaaccgtagcaatcatatacgcagtaatcggactgattgtaaacacaatttccgtattctcaatcaaagaacttccggaggaagaattaaaggcaggcagagaacagacagaagaaaaatatggtttgattgaagccgcaaaacttttattttccaacaaatattatcttatgatttgtgttacttatatttgtcagcagatctattctgctatgttaaatatgggtatttactatatgatttatgttttgaaaaatgaagatttatattcggtcttttcctgggcaattaatatccctgtcatcattgcaatgtgtattacacctatgcttgtggaaaagatgaagggattatatcgaatgaatcttgcaggatacattcttggaacagccggccgtgtcggtgttatttttgcaggctatatgggaagtgttccgctgatgcttgcttttaccgcaatcgcagcacttggaatggcaccatggcagggagatatgggagctgttgtggcaagctgttcagaatacacatacctgacaaaacataaacacattgatggaaccatgtattcctgtacatcctttggaaccaaaatcgggggtggaatcggagttgccctctgcggatggctgcttgatgcaagcggatttgtcaaggaagcggccgtgcagcctgcatcctgcatgaatatgcttcacattatgtatttatggattccaatgatcctgtcattagtcattacatttattatgtcagaaatgaatgtggaagcagcgaaccggcgacttagagaacagatggaggagtgttgacgtggaatatagtggaatgaaagaaattgtatggggtgtatggaaagagagggaaaatatgaacgctgatatgaaatggctggacaatccggaagtgtttaaggtaaatcaattggaagcacatagtgatcattgttattatctggattattcagacatgaaaaaagaaaaaaatccattattacagtcattaaatggtcaatgggagtttgcttacagcaaaaatgtgatggaaagacctgttgatttttataaggaaacatttgatgcatcaggatttgataaaattatggttccaggacatatcgaactggctggttatgataaaatccgttacatcaacacgatgtatccgtgggaaggaaaagagtaccacagaggagcctatagcatggaggcaaccggagcagaagaaggaatgttttcagaggcacagtacaatccggtaggctcttatatcaaatactttgatttggacaggagtatgtgtggaaaaagaatccatatctgcttcgaaggtgtagaagaagctatgtatctgtggctgaatggtcagtttatagggtatgccgaagacagctttacaccttctgagtttgatctgacaccatatattaaggaaaaaggaaatgtactggcagtgcaggtacataagatgagcacagcggcatttttggaggatcaggactttttcagattttttggaattttcagaaatgttacgttgaaggcattaccggatgttcatctggaggatgtatggtttaaacctgtgttaaatcaggataatgtaagcggaagggtatcgactagcatgaaggtatctgcacctgacagtcagcatgtaactgcatgctttattttaaaagacagggaggaaaatgtattagtagagaaatccatacagttaacgaaagaaaacggccatatggaaggcacgatttgtgttgatttggaaaatgtcaaactgtgggataatcataatccatatttatatcatgcttatgttgagcttaaagcagaggatggttctctggcagaggtaattccttatgatatcggtttcagaagaatagagattatagataaagtaatttatctgaatggaaaacgacttgttatcacaggagtaaaccgtcatgagtggaatgcaaaaacaggaagatgcattggtgtggaagatatgaaagcagacatatcctgtatgctcaggaacaatattaattctgttcgtacctgccactatcctgaccagataccatggtactatatgtgcgacaatgcaggtatttatgtgatggcagaaacaaatctggaaagccatggttcattccaaaaacttggggcaatcgaaccgtcatgcaatgtaccgggatctattccacagtggagagatgcagtgcttgatcgtgcaaaaaacaattttgaaacttttaaaaatcatacgtccatccttttctggtcattaggaaatgaatcctatgcaggagacgacattgaggcaatgaacgtttattttgccgaaaagaaggatggaagattagttcattatgaaagcgcttattataatagggcatatgaggatactatttctgattttgagaccagaatgtatgcaaaaccggaggatgtagaggaatacttgaataacagtccgaaaaaaccgtatattttatgcgaattcatgcatgatatgggaaattccatgggaggacttggctcttatatgaagctgattgacaaatatgataggtatcatggcggatttatatgggattttattgaccaggcaattatggtaaaagattccgttacaggaaaagatgttttacgctatggtggagattttgatgataaaccggcagactatgaattttcagcaaatggaatcgtatttgctgacaggaaagagaaaccggcaatgcaggaagtgaggtattactatggcttatacagataaattaagagtggtctatggtgactatacacttggtgtacatggggagggatttgattatattttttcttatgcacagggtggactggaatctatcgttaaaaatggatatgagtggctgtaccgttgtccaaaacctactttctggagagcattgacagataatgacaggggaagcaggtttcacattaaaagcggaagctggctttccgcagatatgttcattgactgtaagggaataaaggtcatcatggatggcaaggagcagatcccatatgcacctgataataacagctatggtggtgatgtttatgcggatgaaattgtcgtaacatacacatacgagaccataaccactccggagacaacggttcttgtaagctataccgttgatgtatctggaaagattcgcgtggatgtacattatcatggggtacagggacttccagaattacctgtatttggaatgagatttattatgccgacactggcagacaaatatttatataagggactctccggggaaacatatcctgacagaaaagcgggggcaaaagaaggaatctatgagattgaagacctgagtcttacacaatatcttgttccgcaggaatgtggtatgagaatggatacagagtggcttgagattacaagacatacggctcttgataacagccggacagacagttcatcacagatactgcgcattgaaaagaatggcgaaaaatttgcattttcctgtctgccttatacagcatctgagattgaaaatgcccttcaccacgaagaactgccaccggcaagaagaaccgttttatgtgtatatggtgcagtaagaggtgttggaggcatcgacagctggggaactgatgtggaagaggaatatcgtatcagtgcagaagataatatagattattcatttaccatatgctgattgtggttatcgttatgggaatgtgtgtatcggtgttatagccggaggtgaagttggtgtgataacgatattgatggtgattttgctgggacctgcagtggatttggtcggacgaataatgaaaacaggaaggggagtggagaaacagggagtataaataaaaggagttgcttgtaagtgctattggtatatgaaaacagaaatacaggagtatccgcggagtggaagaagccagtacatgtgccgccgcatctacatgaggcaatagaagtagtgtatgtaacggatggagaaatagaacttggagtgggacaggaattgttccatatggatgaaggggattttgcagttgtgtttccaaatgtaatacatcattatcaggtgtttggggaaaaagaaaacaaggtcatattcctgtaccttgaaccaacactgtttccttcctattacagggaattgcagatatacagcccgaagaacccggttgtaaaaaaagagcaggtgcatccggatgtggtaaatgccataaaatatctgaccggaataacagagggggatccccggatgatacaggcatatgcacagatgatccttgcacatgttttcacaacaatgccaatgatggataaaagtgcggtagggagtgatgacctgatttataatgcggtagaatacgtggccaaaaattttagggaaaacatcagccttgaaaaaatggcatatgaattgtgtgtaagtaaatatgtgttgtcaagaatgtttgcaaaaacctttcactgtaattttagtaaatatgtgaatggagtccggttaaattatgcagttgcggcactggaaaacacaatggattccattacaaatatatgtcttgattgtggatttgaaagtcaaagaacttttaaccgcgtgtttaaggaaaaatataaaatcacacctagagaatatcgaaaaaggataattatgtaaagcgatgtagaaaaagttgtggtgtttcctgagaaagagaaaacttgtcataacagccgaaaatagatataatagttacacatgtgggataccacaatgaacgaaaaaggcgaggaaacaatcatggcatttgtacatctgcatacacatacggaatattcattactcgatggttccaacaaaataaaagaatatgtaagccgtgtgaaagaactggggatgaacagtgccgcgatcaccgatcatggcaatatgtatggtgtggtggaattttacaagacggcaaaggcagcagatattaatccggtgattggctgtgagatctatgtggcgccgaattctcggtttgatcgcgagaccagccatggcgaggaccggtattaccatctgatcctgcttgcggaaaacaataccggttattcgaaccttatgaagatcgtctccatcgggtttacggaagggtattattaccggccgcgtgtggattttgagacgctgcagaaataccatgagggattgatctgcctgtcggcgtgtctggcgggagaagtgccgcgctatattgtgcgtggattttatgaagaggcaaaaggcattgcaaaaaaataccaggactgttttggaaaagacaactatttcctggaattacaggatcatggcatcccggatcagaagacggtcaaccaggggcttcttcggattagtcaggaactggacattccccttgtctgcacgaacgatatccactatacctatgaaacggatgtggaggcacacgatgtccttctctgtatccagaccggtaaaaagattacggatgaagaccgtatgcgttacgagggcggacagtttttcgtaaaaagcgaggagcagatgcggagtctgtttccgtatgcaaaagaagccgcagacaacacgcagaaaatcgcagaccgctgccatgtcacactcgaatttggcaattaccagattccaaaatatgcaccgccggaaggctatgacagtgcgtggacatttctggatgcgctgtgtgagaagggatttaaggaaaaatatacggacaatccggcgtacgatgagacgcagtgtgcaaagatccatgacgatatggaatacgagcttggcattatccagaagatgggatttgtcgagtatatcttaatcgtgtgggattacatcaactgggcgaaaacacatgactgctgggtcggaccggggcgtggttccggcgcgggcagccgcgtgtgctattgtaccggcattacaaacattgatccggtcaaatataacctcctttttgagcgttttttaaatccggagcgtgtgtccatgccggatattgatgtggattttgagtatgcggagcgttcccgcgtgatcgagtacgtcacagaaaaatatggaaaggattctgtgacacagattacgacctttggtacgatggcagcccgcggtgtcatcaaggcagttggaaaagcacttgattttccgtatgcggagatggaccgtgtggcaaaaatggtgccgatggaactgaacattacgattgaccgtgccctgcaggtcaacccggaattccgcagcctctatgatggggatgcacgtatgcacgaactgattgacatggcaaagcgtctcgaagggctgccgaaccacacatccgtacatgcggcaggggttgtgatctatccgggagaggcgagcaattatgtgccgctggggcgtgccagtgacggaacaccgacggcagagtacaatatggtacagcttgaggaacttggtcttttaaagatggatttcttaggactccgcacgcttaccgtattaaaagatgccgtcaaaaatgtaaaggcatcccaaggcatcgacattgacatcgatcatatcgatttgaatgataaaaaggtgcttgattttatcggaaccgggcgcaccgagggtgtgttccagctggaatctgcgggcatgcagaacttcatgaaagagttaaaaccacagaatttcgaggatatcgttgccggaatttccctgtaccgtccgggacctatggattttattccaaactacatcaggggaaagaataatgcagacaccgttacttacgtgacgccggaattgcagccgatccttgagccaacgtatggatgtatcgtttatcaggagcaggtgatgcagatcgtacagcagcttgcggggtatacgatgggacaggcggacaacatccgccgcgccatgagcaaaaaaaagcagtatgtcatcgatgcggagcggcagagtttcgtctacggagattcagagcgcggcatcaggggctgcgtggcaaacggcattgatgaaaaagcagcaaacagtatttacgattccatggtggattttgcaaagtatgcgtttaacaaatcccatgcggcagcctatgcggtcatcagtgtgcagaccgcgtggctgaagttttactatccggtggaatttatggcagcacttatgacgtccgtgattgacaattcggcaaaagccgcggagtatctgctgcattgtaaggaactcggtatttccgtgctcccgccggatatcaatgtgggacagggagaattcacggcagagggaaatgccgtgcgctatggtctgtatgccattaaatccctgggacgtccggtgattgacagcatcatcggggaacgcaaaaaaggtggttcataccgcaccctgcaggattttattgaacgtacggtgcagcgggacatcaacaaacgtgcgatcgagaatctgatcaaggcaggtgcctgtgatgggcttgacggtaaccggcatcagatgtccattgtctatacgtccattgtagatgatgtcgtgcgacggaaaaagaccgggctggaaggacagatgagcctgtttgattttgtcggggaggaagataaaaaggactacgaagtccattatccgaatgtggaggagttcccgaaggaagtgctgcttggctttgaaaaagaagtgcttgggatttatttaagcgggcatccgctggaagattaccttggtaaaatgaagaaaaatgtcacggcaaatgcagcggattttgtcagggaagaggaaagcggcacaattcgtgtgacagataatatgcatgtggttgtgggtggcatgattgcagcaaaaaccgttaaatatacaaggaataatcaggcaatggcatttctgacagtggaggatctgaccggttctgtggaaattattgtattcccaaaagattatgagagatacaatcgctttttgaatgatgaggagaagattttcgtagtcggacacgcaacggtggaggaggaacaggacggaaaagtgatctgcgagcggatcgttccgtttgacgataccagaaaggaactctggctgcagtttccgacaaagagtgatttttctgagaaagaacagcaggtgtatgatattctccgggattcggacggaaatgatgaagtagtaatttatatatcggatgtcaaagcctttaaaagattgccaagaaaccgtgcggttggtacaaattctgtgctcttggcacgtttgacggaatttctgggcgaaaaaaatgtaaaagttgtagaaaaaggcattgaaaatcgcgcataataagtatagaataaaacagattaaagaatttcattttaattttaataaatggaggatttcacaatggcgaaagagattaacacaattggtgtactgaccagtggaggagatgccccgggaatgaacgctgcaatccgtgcagttgtccgtcaggctatatccaaaggaaagaaagtgaaaggaatcaagcgtggatacgctggattattaaacgaagaaattattgatatgaacggacagagcgtttcagatacaatctctcgtggtggtactattttacagactgcccgttgtatggagtttaccacaccggaaggacagcagaaaggtgcggagatctgtaagaagcatggaatcgatgcaatcgtagttatcggtggagatggttctttcaagggtgcacagaagcttgctgcattgggaatcaataccattggtcttccgggaaccattgatctggatattgcatgtactgattataccattggttttgacaccgctgttaatacagccatggaagcgattgataaggtccgtgatacttctacttcccatgagagatgctcaattattgaggttatgggtcgtggagccggacatatcgcattatggtgcggtcttgcaaacggtgctgaggagattcttcttccggaaaaatatgattacgatgagcagcgtctgattgatcaggtagtcaacgcaagaaagaacggaaagcagcactatattattgtaaatgctgagggtatcggtcattcacagagcatggcaaagcgtatcgaggaagcgacaggtgttgagacacgcgcaacgattcttggacatatgcagcgtggtggaagcccgacatgtaaggaccgtgtctatgcaaccacaatgggtgcaatggcagttgaccttctctgcgaaggaaagagcaaccgtgtcattggacataagggtggcaagtttgtagatttcgacattgatgaagctctggctatgaagaaagatgtcgatgagtacatgtacgaaatctcaaagacactggtatagttattccttttattggagaacatagtgcggcagggaattctctctgccgcatttttaggtttgaaatcaatgggattttcaaggagacgggcaatggacaacaccaaggaaattctcacactggcagtagaaatcggggacgcgatgctgcggtgcggagcagaaatttaccgggtggaagattctgtgatacgcatattggaagcttttggtctggatgattttgatgcttatgttttatccaacggaatttttgcaagtgcaaatgagagcagggaggatgcctgcagtgtggtaagatatgttccgctttcggcaacccatctggggaaactcgctgcattaaatcagctgacccgagatatctgtaatcataaatgttcgatttcggaggcatcggagcggttgaaacagtgcaaaaacattccggtttatgcgaatgcggtacagttactggcatgtggaatcggttgtgcagcgtttaccttcatgtttggagggcatctgtcggaagcactgtatgcattttttgtagggctgatagagcagctggcattgtttgtgtgccggaagcgtaaagtttccagatttttaacgaatgtatatgtcagtctgctgatctctttgcttagtctgccagcggccgcgggtgtgatacctgttttgcatgacaaagtggtgatcggggcaattatgccgttagtacctggaattgcactgacaacatccattcgtgatttttataatggcgattatttgtccggaacgatccatctgattgatgcacttcttacggcactttgcattgcagtgggcattgcactgccgattctgttgttgcgatatggaggaaatttaccggtatgagttatgtgcttcagttttttattgcagcggttgccacggttacttttgccattttgtttgcggcaccgaaaaaggaactggttttctgtggcgtatcaggcgggcttgcctggctggtttattttattttgtacaggcagtcggggaatgtggttttgggcagtctggtggcaacctttgttttgacaattttaagtcgtattctggcagtagcaagatgcaatcctgccacgatttatctggtatccgggatttttccactggttccgggagccggtatctattatacggcatattatctgatatccggaatgccggcaaaatgctcggcaaaagggctggaaacttttgagattgccctggccattgtatttgggattatttttggcttctcgattccggaaacactgtttcataaaaggaaacagtaagtaatgggaaaggattgtacggatgatatgattacaagcagtgcaaatcagcagatgaaacatctgtcacagctgatgaaaagggcgaaagaacgaaaaaaagaacaggtctttgttgtagaaggaataaagatgtttcaggaagcaccggcggatacggtggtgtctgtctacgtgtcggaaagttttctggaaaaaccggaacatgaaaaatgtctgcagggataccggtatgaggtcgtgagtgatgcggtattccgggaaatttcggatacacagactccgcagggaatccttgcgattgtccgcatgccgaagtatgatctgcccgatcttttgcagggggatcacacgcatcttttaattcttgagagcgtgcaggatccgggaaatcttggaacgatggtgcgcaccggagagggtgccggcatcacgggaattataatgaataaaacgacggtggatctgtttaacccgaaaaccatacgctcgacgatgggaagtatctaccgtgttccgtacctgatcacggagcatctgccggatctgcttgatgagctgcataaggagaatatcagattgtatgcggcacatttaaaaggagatacatattatgatgcctttgattttaccggggcatgtggcttcctgattggaaatgaggggaacggtctgtctgatgaaattgcagagtgtgcggattgctatctgaagattcccatggagggaaaggtggagtcgctgaatgcagccgtttctgcagcacttttgatgtatgaatgtaagagacagcggggagagcacaatgaaaatatggtttaaaatctgggaaaacacacacttattaaaatcggaaaccatagaagatgatacggaggatacacgtacacataagatttttcatgcgcttgaagaagtctgtctgaagtgggatcttggaaaaccgatctggtttgatgcgaatatagcggaatttcaaaggcatgcgcgaacgaggtttggcaaggacaattttgtggaggaaacagaatttgattatctggagatacaggtgatagacgaagattaaaaaaatattaaatttgttgctttctgcgtacagaacgtgtttcttgtgatatgataataccatatgggaaagcacgttaatacatgtgtgaggtctgctttcgcatttatgaaaggaatgtctgccattgtggcaggaaagaggaggaatgacatgggaacatcgcagatgctgggggaagatattgatagttgggaaactatgatgtttttatataattctgcactgaaagaggtgggaacaaaacttgagattttaaatgacgagtttgttcatatacataagtacaatccgattgaatatattaagtcgaggattaaaacaccggaaagtattgtaaaaaaattaaagcgtgacggatatgagagtacgatcgagaatatgagaaattatattaacgatattgcaggaatccgtattgtctgctcgtttacttcggatatttaccgtcttgcagagatgatcggaaaacagaatgacctgaccgtgatctgtgtaaaagactatatcaaaaatccgaaagtcagcggttacaagagttttcatatgcacgtgacggttcctatctttttatcggaccgtgtggttgagacaaaggtggaaatccagatccgcaccattgcaatggatttctgggcaagtctggagcacaagatttattataaatttgaggggcatgccccggaatatatcagccgggatctgcgtgcctgtgcagaaattgtttcaaacctcgatgcaaagatgctgcagctgaatgaagcaattttagaagaaaaggaaaaagaggaacagaagaaaaaggaagaatagttacgaagaataaaactattacggaacagtcggaaagaagggaatgctatggtaccttccattgcacgtcagagtgtgattttaaaatgtaatatgcaaaaatccgtgatgcttggaaactacgaatttttctatgctgcgggattgatgagaaaattatacaacatagagatccggacagatatggaaccggaacagattctggaagcgattctgcagatgcaggataatctggctccgcagagtgaacaggaaaaatatctgatacagatcataaagaattatgagccgtcagcggatcatgatgcacagatggatgagctgtttgcctggggagaacaggaacctgacatgtggcaggtcacgacatcgttccatccggttataaggtaactatgagcgatagttaccttatatttttgcaattttcgtacatactacaagtaattttaaaagaaagatgaggatgtatgaaatgagtaagatgactctggaacaggaagaagtgcgcaatcaggagtataatgagtatgtcgaacagatgacaccgaaacataatctgtgggcaaatatgggaaaagcctttttgctggggggaggtatctgcctgttgggacagattattttacagattgcagccggggtattcggacttaaggcagaggatgccgctctttggtgcagtttacttcttgttcttctttcggtgatcctgacgagctgtaatgtatatgggattcttgccaactggggaggtgcaggggcattggttccgattaccggatttgcaaatggcgtgtgtgcttctgcggtggaattccagaaagagggacaggtatttggtatcggatgccagatttttaagattgccggtccggtgattttgtatggaattttttcaagctgggtgctgggacttatttactggctattttaaattcgctggggaactgcgtggtccgtcgcatagagaaaacttatgtttttccgtgtactcttttcaattttgcacatactaccgtagagaataagtaatcaaagaggtgcagaatgaaagaaaaacgggaaatagtttatctgaaggcagaccgcaacagtgtctgccatgatccaaaaataaagatacaggatgtgatgtctgtacagtgtgcagatcctgcaatctgtgccggaataaaaaataaaacactgtatacatttaagaaaaacgatggccagaaaaaagaaggaaaaaagaaaaaacgaatggaagtattttcgatgctaaatgtgatcgaacggatacagacggattacccagatgtggaaattgttagtatcggggaacaggattttgtggtgcaattgttagatgcaccgatggcaccgaaatggctggagacgcttaaagttgttgtgatggttgtagtaatctttcttggagcggcatttacgattatggcatttaacaatgacgtgtccgtgggggaagtgttcgaccggttttatcagcaggtgatgggaaaagaaaaaccgaaagtatcagaaatcgaaattttttactgtctgggactggcagtgggaattttggtattttttaaccatatcggaaagaaaaaaatcacttcagatccgacaccgattcaggttgagatgcgaaagtatgaacaggatgtcgatatggcgtttatagagaacgcgggaagaaaggggcatgaacacgatgtttcttagacacatttttatggcgggccttgcgacagcctgcggcattgcggtttctgccggaacgtttgcgtttcttctggtgatcggggtcattccgcgcatgatcaaacgctgcaattttggagaacggatactgatggtcgaaaatacggttatactgggggtattgaccggtgccgtattttctgtggtggagtggaaggcacagctgccgtatccgtggctggcgcatgtcattttgggcgcttatggaactgcagcgggaatttttgtgggatgtattgcggtggcactggcagaaatattaaatacttttccgatcctgttccggcgtctgtatatcaaccgtggactcagtggtgttatgattgccatggcactggggaaaatggctggttctttttattatttcttttttggttacgggcttccaaaatattggtaaatccatattttctaattgcaatcttctttgtgactggcgtataataaaaggtacgattagtttcaggaggattttaaatgggcagatatgcattgaatatggaaaaatatgcagatttggcaaggactgcatctgcggagggatgcgtgttattgaaaaatgacaacagtaccctgccacttaaaaaaggagataaagttgctgtatttgggcgcatggcgtttcattattacaaaagcggacttggctcgggcggactggtaaatacacgctatgtggttggaatccttgatgcgctgcgcgcctgcaaagatattgcgctggatgaagaactgattgggatctacgaaaaatggatcaaagaccatccatatgacgaaggtgagggatgggggctggttccgtggtcacaggaagaaatgcccgtgacggaagagatgcttcaaaccgcatccggggatgatgtggcactggtgattcttggacgtacggctggggaagaccaggacaatacggacaagccgggcagttataagctgacacggacagaagaagacctgatccgtaaagtgagcagtcaattttcacgcacggccgttattttaaatgtgggaaatatcattgatatgaaatgggtcagagaatttgatccggcagcggtactctatgcatggcagggaggtcaggaaggtggaaacggtgtctgtgatgtacttatggggcgtgtgaatccgtgcggaaaactgaccgatacgattgcagaggatatcagtgactatccatccacgtcaaatttcggggatttacagaaaaactattataaagaagatatctatgtgggatatcggtattttgagacatttgccaaagataaagttttgtatccgtttggatttggattgtcgtatacttctttttccgtgcaagcgtctgcagaagaaaaggacgagcatacggtctgtgtaaaggcaacagtgaaaaataccggaacaaaaccggggaaagaagtgcttgaagtatatgccaaagccccacagggggtactggatacaccggtgcgtgttctttgtggatttgcaaagacaaaggaactggcagcaggggaagaagagcatattattctggagattccgaaaaatacatttgcctcctatgatgacagtggtgtaaccggacacagggactgttttgtgctgctggagggtacttataccatttatgtgggaaccgatgtgcggacggcacaaaaggcaggcagttatccgcagacgtttacggtgattgaacagcttgaggaagtctgtgcaccgcagaaaccgtttgcccgtatgacaagaaagccgggtgatgtgatcggatattccgatacaccggaacggatctatggtccgtatgaccgcgtggaaaaaccggcagagatttcacagactggcgataaaggctatcgtctggaagatgtatatgacaaaaagatttccatggagacatttgtggcacaattatcggacgaggatctgattatgctgttccgcggagaaggcatgtgcagtccgaaggtgactccgggtactgcagcggcatttgcaggactgactccgtctttgaggaagtttagaattccagcagaatgtgcatcggacggaccatccggaatacgtatggactgcggaacaaaggcgttttcccttccgaacggaacgctgctcggatgtacatttaactgtgaactggtgcgtcaattatatgaaatgacagggcttgaactacggttaaaccgtgtagatacattgctcggaccgggattgaatattcacagaaatccgttgaacggacgaaactttgagtatatttccgaagatccgtttttaaccggaaaaatgggagccgcacagctgcagggacttaatattgcaggttccacaggaaccatcaaacattttgcggcaaacaatcaggaaacgaaacgacatgaggcagattcgattatttccgtgcgggcactgcgggaaatttatctgaagggatttgaaattgcggtaaaagaaggaccggcccgctctgttatgactacctatggcccggtcaacggggtgtggactgcaggaagttatgatctcaataccattgtattgcgcaaagactggggattttccggcatcgttatgaccgactggtgggcaaaggcaaaccatgagggacagccatcggatccgcgtatacatgcggtcatggcagcggcacagaatgatgtatatatggtgactgcagatgcgcaggatatgcagcaggatgatatgctcgaagaattccagaagggaaatcttacgagaggacagctgcagagaaatgccatcaatatattgcagtttgtactaaaatccccggcgatgctttatgagatggataggatttctccggaagaacttaaagaccggaagaatgctgcaaaagatgatccggatgtctcaaagatgatgaaatttgtgacagatgagcagggaaatatccgcatttccggtggcggctgggatacacatcagggaaaagaaatacttgcggatctggatatgaaagccggaagttatgaactgcagatgaaagtgaaatcaaatctggatgatctggcacagcttccggtaacagtatatctggataatatcatcaaaggaacactgtcatttaggggatcgaaagggcagtgggtgacacagcagatccggtttgatacattcgagggacatcattatatgaaattatattttggggcaaccggacttacggtagatcatatagcgtttcagctgtccgggggcgcagacaaggagcagtaagacatgaatgttttaaaggtaaaaaagggagaaacgcttgccagaaaacaggacaaggtgatggaatggtatctgattcaggagggatcggtgatccggcagtttgcatttgcagagatcattatgcaccggaatgcaattgtgggtattctcgagaacgaatggtttgcctgcgattatgtggcaaatgaagatacgacattgattgtgattccatgtaaaaatgcacaggatctgcggaagattttgtccgaacatgagaatttccgcccgatttttttgcgtacggcagtggaacagcggcatcaggcactgtgtctgtatgccagtctgcagaaaaaatgcatgcttttacataatgctgcggaaacgttgtacagcgaatacaaaaatctgtgcagcgagaagcttcttgatgaacaggattttccgcgtatggaacagtttgcagctttaaaaatgcagcaccgtgcggaaaactgggagattgcaaacagtaacagtctggtccggagttatctgaaagaatatatgcagctgatgatcaaagatgacagtctgtgtgtgggagcaatcatggaggcggcggcacagatgcgtcgtgtgacacagggaatcggcgagatggtaaattatctgcagtacaacagggatattttattttcagattccagagatgatatttttcgtctgttttttacaatggcagtccagcagtcgcagaaaaagcaggacatttccgagatcaaaaagcgtctgttaaatatggtggatgtcatgacaaagcttgatgtgtacgataaaaaacagatggcggaggcacatgagctttgcgagaattacgactttaccaaggagtccgaaggccgtatcaatattatgcgtgaggattgtattgcacatattatggagtatgcaggatatggcagcgatatgatcagggatttccacagcattgtgcagcagtaccgggagctgccggatatgatgtctacagacaatgaggcgagacagctgcgcagggaaatcacaaaggtcttttacgatatttataccaaggcgtttatgagatcagttgaggaactggtcaagccgtcaccgatcatgatgatgtttttcaattttgggtttatggatgcggaggtgctgggggaaactaacacaaatgcactgtataatctgacggattcgcttggattgtttcactctgcaaatgtctatacggtttatgactggctggtacagatttatcagggaaagaaagacccgtctcgcaatgaatttgaccaggatttcaatgcatttctgctggaagaaaagagaactgggaatattacggaagcgcagatgcaacagtataaaaatgacagcaggcagaaagtacagtttgagatccacaatatgtttacctccggaaaccgtgtgacctatggccgtgtgactacattctgtccggttctgatggaagaggatttcatcaacaccgtggaaaagatggcagttaccgcagaaaaaattgccgatgccatcaataaggtgcgctgtgtggattattctgcactctatcatgatgtcatgttttccgatccggatcgcggaatcaatcaggaatggatcaaaaaggagattttgccggatgtgattctgatgccaaatgccggaacccgtaccctgatgtggcaggagacatccggggccaagattgatacaccagcgcgttttctgtttccgatcttttccgcagtggatctcgatgatcagatggtggaatgtatcggccgataccgctgggagatctgcagacgtgtgcagggtgtatactggaacgatatccgggagaaatcgcttacggcggagtactgtgattttattcagtattatcgcaaaaattcagatctttctgcagatgcaaaggaaaagatcaagactgcattgtcccgtgcgcgcaacagttaccgtgaggtatttgtcaaggattatcaggcgtggatgaagtatgagtcacagggaagtttccgactgaataaagtggcaagagatattttggtaaggtattgtccgtttgcaaaggatatccgccagggactggccaccaatccacagtatcagaatgcatttcacagacttgatgcggaaaacagaaagaaactgcagcggttccgttctgtttacgataaatatgaagcagcaggtggagagatcacaccggaactgaaagaaaatctgcggttttatcagatgtaggaacggatatggaatatatagcttatgtagagaccccgtataaagaaaaatttggaattcccagacagagtgggctggcggagagtacctgtggggaaattattttcacaccgaaattccggaatccggatgcagtgcgtggaatcgaagagttttcccacctgtggcttctctgggagttttcgagggcaaagcaggatacctttcatgcaacggtagcacctccccgtctgggaggaaaagaaaaacggggcgtgtttgccacacgttccccctttcgcccgaattcgatcggtctttcgtgcgtgaaacttgaaaaagtgcgcatcgatcagaagcttggaccggttcttacggtttccgggctggatctgcttgatcacacaccgctttttgatatcaaaccgtatctgccgtacgtggatgcccatccggaggcaaaaaacggttttgcggaagaattcctggagtttcagataccggtagtatttccggaggaattgcaggcacagattccggaacatctgcggggaccgcttcttgaggttcttgcacaggatcccagggcggcatacaacaaaaagccggattatatctacgggatggcatttgatgattatgacattcggtttacggtggcagagggaatcctgacggtaaaagaggtcacaaggcgcacgcaggaatggaaaaaagtcaagtgagagttgcgcttgtgcggggaaagtcttataatagaaacatcaaaagtcaaaaacgcgaagaaattcgtgtagtagtgaggtaagaggatgaaagagttaaaagagtacattcgcagtatcccggatttcccggagaagggaattattttccgtgatgtcacaagtgtactgcaggatgcagatgcactgaagctttccattgatgaactggcaaaacgcttagagggcgttgattttgatgtgatcgccggagcagaatccagaggttttatctttggggcaccacttgcttatgtcatgcataagccgtttgtaccgattcgtaaaaaaggaaaactgccgtgtgagacagttgaaaaaacatatgatctggagtatggtacggcaacgattgaaatgcataaagatgccgttaaaaaaggagaaaaggttgtacttttggatgatctgattgcaaccggcggaaccatgaaagctgctgcagaactggtagaggaacttggcggtgaagtggtaaagatgctgtttctcatagagttaagcgatctcaacggacgggaagtcttaaaggactatgacgtggactctgtcgtacagttcgaaggcaaataatcgaataaaaaagaaaattctgcacatactgtatcaaaaacaaagtaaggagagacagtatggatcagcaggttggatcagggagtctttgctttgcaaaggctccttttattattggaacagcatctgtggttggaaccaaagagggggaaggccccctggcagatgcatttgactgtatcggaccggatgataaatttggtcagcagacatgggaggccgcagagagcagtctgcagaaagaagcattgacgcttgccctcgggaaagcagatcaaaagccggaagatatgcggtatctgtttgctggagatctgcttggacagctgattgcctcatcatttggactgaaaacgtttgaaattccactgtttggactgtacggggcatgttccacgtgtggagaagcgctggcactttctgcaatgacggtagcggccggatatgcggatcgcgtggctgcagtcacttcgagccattttgccagtgcggaaaaacagttccgttttccgctggaatacgcaaatcagcgtccggtaagtgccacatggacagtgaccggaggcggtgcatttattctgtcaaaggatgcgaagcagccgctggcaaaggtggcgggggtcacaaccggaaagattgtagattacggaatcaaagattccatgaatatgggagccgtgatggcaccggctgccgctgagctgattgcgcagaatcttacggattttaaacgaaaacccgaagattatgaccggattatcacgggagacctgggagaagtcggtcagcagattctgtttgatctgctgctgaaaaaaggcatggatatccgcaagcagcatgaggactgtggcatgttaatttttgattcacagacacagggaaccggttccggaggatcgggatgcggatgtgcagcctcggtgctgagtgcgcattttctgccaaaactggcaagcggggaattgaaaagaatactctttgtgccgacaggagcactgctttctacggtcagtttcaatgaaggacagacaataccggggattgcacacggtgttgtgctggaaagctgtatttcatccgcaaaaaaggagggataaggatatgcagtatgtaattgcatttgtaacagggggaatgatctgtgcactgtcacagatcctgatggaaaaaacaaaaatgcttccgggacgtatcatggttcttttggtctgccttggggccatccttggatttgtggggatctatgagccgttttccaaatgggcgcaggcgggcgcgaatgtgccgcttctgggatttggaaacaatctctggaagggggtcaaagagatggtggacaagaaaggatttatcggtatttttctgggcggctttaaaaactgtgcggcagggctttccgcagcactcgttttttcttatattgcctccctgctctgccagccaaagatgaaaaagcactagcaaatctggaaaattctgttgtataataaatgggaattttgcacacactagctctgtagatcaaataaaaggagatatgtgtgatgaaaaaattaaaagttctgatgatgagcggaatgcttgcagcagggatctgtctgtttgcggcctgtggtacagcaaatgatgacggaacgaacaatggtgtaaacgatacttccaatacacaggttactacacaggaaaacattccgggaacggacaatacgactggaaatggtacaacagacaataatacggatgccggaaattccaaaaacgatggcaatgtcggaaaagatatcggggatgtgggaaaagatgtcgtggatggtgtgaaagatgccggtgatgctgtggcagatggcgtggatgatgcaattgacgcggtagatccggatgcagacacaaacaatggcggtaagaccaataccggacgttagacaggattacctatgaaaaaagaaacttacgttaaaatgacccagccgtttcgggatgacccgaaacgtgcgcgggcgttacatagagcaaataaaatattgacggttgtgatttttgtggcatatccatgcctgcttctgtggctgctgtggcagaaggatatgcggctatataaagccatctgtgtgccgctggacggatttattattgtgacggttgtgcgggcctggttcaaccggaaacggccgtatgaaatatttgaactgccatctgtgattccaaaagatacgaaaggacattcctggccgagccggcatgtgttttccgcggcagtgattgcgtttacgttctggtttgtgtgcccggctatgggaattgtatttttgcttatgacagttgctattgcatggatccgggtagtttccggagtgcactttatcagtgatgtagtggcgggatttctttttgctgcgtttttttctttgtttttttagtgtggttttcaccggctatgccggaaaaattactggctttctttccggaactggcgcggtgtcatgctgtatttttgtttgaacacccggttaaaataggaaagattttcaaaaccggattctgccgcaatatccagaatggaggagtcggaagttgtcagcagacgcgaggcgattgtcaggcggtagtcccgcagatagtccacgaaagacgttcccatagtttctttgaaataccgcataaaatgagattcggaaaaatcaacggttgccgcgatgtcggcaatcgttattttttgcatgtaattattttcaatgtattttaaaacaattttcattttatcaagcgttttgcggttactgcctgtcgttaagttccggcagcggttgtctaaaataaagaaaaactggtacaactgacttttgatgtacagttcatagccctgtggtttggtcttgctgatctcgtcacaggcatcaattggcatgatgacatctgtgtaataaggatagacaggggtgaagatggttggaaccgtgacttttccgctcataagaggaagaagaaaatcggtggcagtcacatcgttctgccgtggaatcagcatattcggattaaagatgatattttcatattccatgaaggcatcttccagctggtcaatggagtggagctgtcccggaagaataagaaccagagtcggaccttttactttgtattcccggaaatctaccgtaatgcgtcccatcccttttttgatgtagatcagttccagttcatcgtgccagtgcagcggtacacgcggaaaatccagtgggatcgagcatagatatgtattataagggaagatgatatccccatgtgtgatggtttcgtgataattttcatattcaagtatattcatatctttattttagcagaattgtcctatgactgtaaaggacaaaaacgacagaaaacgcatgaaacaggcgaaaacacaggatatgcaggcactgtggaaatgtactaagacaggtggcacgaaattggtggaatttaacagctgggcgttatttgaatatgaaaaatgatagaatagtatcagtttttgcttgaatacgacaagaaatcagcaggaaaaaatcatatactgagtacatcaaaacaacacgaaatcttgtgggagggaaaatacatgactttagcaaaagcagtatccatgaagtataacaagaccattgagaagtgttccaatgaagaaatttattatgcacttcttgacatgacaaagcagatggcagaggacaaggtcagcaatgagggaaaaaagaagctgtactacatctctgcagagtttttgatcggaaagcttttgtccaacaacttgatcaaccttggcatttatgacagtgtaaaatccgaacttgaagcatctggaaaaaatatcggtgagattgaggagatcgaacttgagccttcactcggaaatggcggacttggacgtctggcagcatgtttcgtagattccatcgcaacactcggattaaacggtgacggtgtcggattaaattatcactacggattgttcaaacaggtatttgatcacaatctgcagaaagagactccaaacccatggatcacaccggacagctggctgacaaagaccgatatcacctatccggtacagttcggcggatttaccgtacagtccagattatataacattgatgttgtcggatacaacaaccgtacgacaaaacttcgtctgttcgatatcgaaacggtggatgagagcattgtcggagataccattgattttaacaaagatgacattgcaaagaatctgaccttattcctgtatccggacgattccgatgataagggacgtcttctgcgtgtatatcagcagtatttcatggtaagcaatgccgcaagactgattcttgatgaggcagttgagaagggatcaaacctgcatgatctggcagattatgcgaccgttcagatcaacgatacccatccatccatggttatcccggagctgatccgtctgttacaggagcgtggaattcttatggatgaggctgtatctattgtatctaaggtttgtgcatacaccaaccacacaatccttgcagaagcacttgaaaaatggccgatcggattccttgagaaagcagttcctcagctgatgccgatcatccgcgaattggacaaccgtgtacgtgcaaaggtttccgatgaaagcacctatattatcaaagacggtctggtacacatggcacatatggatatccactacggatacagtgttaacggtgttgcatatctgcacacagagatcttaaagaacagtgagttaaataacttctacaagctctatccggagaagtttaacaataagacaaacggaatcacattccgccgctggctcatgtcctgcaacccggaactttccgcaatgattactgacctgatcggcgatggctggaagaaggatgccaatgagctggagaaacttggcaatttcgtaaacgatgatgccgttctcgaccgtctccttgcagtaaaggccggaaagaaggcagatctgaagaattacctgaagatgaaacagggatttgatattgatgaaaattccatctatgatattcaggtaaagagactgcatgagtacaagagacagcagatgaatgcactctatgtcatccataaatatttcgagatcaaggaaggaaagaagccggcaactccgatcacggtattcttcggagcaaaggcagcgcctgcatatattatcgcaaaggatatcattcacctgattctctgcttacagcagatcatcaacaatgatccggaagtcagcccatacttaaaggtatttatggtagaaaactacaatgtaaccatggctgaaaagatgattccggcatgtgatatttccgagcagatttccctggcttccaaggaagcatccggaaccggtaacatgaagttcatgttaaacggagcactgacacttggaactatggacggagcaaatgttgagatcgcagagctggttggaaatgagaatatctttaccttcggtgaggattcccagactgttatcgaccgctatgcaagaggcgattacaactccagaagctactatgagaaagattctgagttaaagagagccgttgactttattgtaagtgacactgtaaagtctgtaggatgcagtgagaacttagagcgtctgtacaatgagttgttaaacaaagactggtttatgacattcccggatttcgaggaatatattgcaaccagagagaaagcttatacagcttataccgatcgcaaggcatgggcaaagaaagcactgatcaacatcagcaaggcaggtttcttctcatctgacagaaccatcgatcagtacaacaaagaaatctggaaattatcttaattgaatataggaatacaaataaattgttattctcctccttagatgggaaccggacggatggtccggttccttttttagcatttttgggattgttaaaatttgcaaaaacaatacaaatgtattgaaatagaaatgatttagcattataataaagaaaatgaatggaagtggaggtgctgaatatggctagtacaattcaagtcagggtagaagatgagttaaagaataaatcagatgcattatttaaagatctgggtacagacacaacaacagcaatcagaatgtttttaacacaggctgttgctacaaatggatttccttttgaaatcaaaagacaggcagaaacaaatccatatgcaccgatgactgagaaagagatgcttgcaaaattgaaaaagtccagagagcaggggaagttcagagatgcagatgatgtgatttctgatatgaggtcaaagtatggactataagattgttttatcaaggggtgcggaggaggatcttgacggattcgttgcatatcttttgtttgaaaagaaaagtgaacaggctgcaagaaatttattaaacgattttgaggcaacaaagacaagtttgtcaaatgttgccggaagtctgaaactctgtgataatcccaaactaagagagttaggatactacagaatcaatttcctatcgcatcgatattttatgttgtatcgtattgaaaacgatacagtttatgtggataatatttttcatgaattgcaagattatgagaataaattaaattaaatatttaaaaattcctatctatggggtatcttttaattttgaatattatttaggagattactcaaataggtaggaattttttatggaaaagaatccaattgctgaatgtaataagattcaaaagaaatattatccagagttgtttgccaaattttctgggggtgaatgatcctcgaaatcagagttatatagattatccagtcagggtcatgccgggaaccatgtactacaaatgcataggtggaatttcaaaaagactgcttctgtatcgatgaccgctatggaagagttttgtatatgcaggactatgccagttatgtaaaagatgacatgatttccgagctctgtgatctgagccgggatctgatgttatccattgatatcctgcccgtaccaacggatgaggcagtgcggtttttatcatactgattttaattgtagtattatcggcggagctgcttttatggggaatttccagagtgcagagcctctaagtgcagaagtactggcacataccccgacgatccagaggtatgccagcgaatatggaatcccagagtatgttgcggtgatacaggcaatcatgatgcaggaaagcggaggaaggggaacagatcccatgcagtccagtgaatgcccttataataccgagtatcccaatagtccgggagcaattcaggatgcagactattccatcaatgtgggaattcagtattatgcagactgtatccgggagcatcccaacagcaggaagtattatcttttttgactgggatcatgatggtgttagtgaccatgtgggaatcgtggaaagctgtgatggaacgacagtctatacggtagaaggaaactccggagatgcggttaaggagaatagttatacggttcattcagcatctattatgggatatggaattgtttcagggatgtgaaagtctatatcgtagaggcaaaagcatatgagagaattagttctttagttccagcacatcagccactacttcatatttcagtgtaatacgctggttcattatttgcttacgtgcatattctgccacaggcagatttgctgtttgggcattttctgtgacaatatcatattccatatcgttgagacagagcatgatgtgatggtttcgtttcagttccttttgctttttgggtcttgccatgttttatcctttctcgtgatagaaccatcacgctgcgactatattctatatagaagccgaaaaatacagcttgctgtgtaagaaaccgagggaatggggaaccggaatccccatcaagattgcccgtaaccaaaatccacgaagtgggttttgagttacttgggcgaatcttgctctaattaaagtaattgcagaatgaatttttatataattctaaatatataccattttttatattcatggattgtttttatgaaaataatggactatattgccaaagtgatgtggaagagatatactaaccaatagaaaaataaagaggcaagttcaaatggagagaaaaaatgtataagatattgattgtagaagatgatatagatttgaaagaaggtctggaatttgcattaaaagaagacgggtatgaagtcttagtggcggaaacaaaaaaagatgccattatatgttataaatcccacaattttgatttggttttaatggattgcaatttgccagatggatcaggttttgagctttgcactgatatacgtcaaaattcaaatgttgctattttgatgctaaccgctagagatggagaattagatgaggtaaaagctttaaatttgggtgtagatgattacatgaaaaagccattttctttagcggtattaaaagcgagaattagaaatctattacgaagaaaggatgcagacaattttattgaaagtaatggagtaaggataaatactactaataatacaattcacatgaatgaaatagaaattgatgtgactgcggttgagtacaaactacttagatatttgatggaaaataaggatcaagtattgtcgaaagagcaaatattatcttatatatgggatgctgaagaaaaatatgtggatgataatattgtttctgtaaatattagacggttaagaattaaaattgaggaagaaccttcacaacctaaatatattaaaactgttcatgggatgggatatatatggaaaacaaaattttaatgttattatgtattgtagttgttattctattttatctgctggtttattatagaaataaagcaaacaagatttacacagaatctgataagttacttgacaagatattagaaaattctcatatagatcaaatagaggttaatgaaggtaaaacttcagctttagccagcaaaataagcaaagttcaagaaaaactgttgattgaaactgggagagctgagaatgaaaaagaacaaataaaatgtcttatatctaatatgtctcatcaattgaaaacaccattagccaatgttatcatgtatgaagatatattattagaaaaactagaagatcctcaagttcaaaaatttttgtataaaatgaaggatcaaactaaaaaaatagattggatattaaattcattatttaagatggtaaaattagagcagaatgcattagactttaatatagaaaataattcagtaaaagatacgttagctatggcattaacaaccgtatatgaaaaagcagaaaagaaggacattagtataaaagtaacaggtattagagatcaacaatgttggcataatccacaatggacagccgaagtttttgtaaatattttggaaaatgcaattaaatactcggatgtacataaaaagattagtatttcaatgaaaacatatgaaatgtatagtgaaataggcataaaagattttggtattggcattcctgagtcggatcaaccgcaaatatttgctagattttatagaggaaaaaatgtgaaaaattttgagggttctggaataggattgtatttatccaaattaataattgaaaaagaaaatggatatattactgtggattctcatattgaaagaggtacgtgtttccatgtgttcttacaaaattgtaagaattaaatgaaattttgtagccttactgtaagatatatgtagtaggatataagtataaaaggaggttacaaaaatggaagttttaaaaactgttaatttaacaaaaatttatggctatggcgaaaatgaagttttggcattgaataaagcgaatatagaggtgaagcaaggagaatttgtagctattttaggaacatctggttctggaaaaagtacttttttaaatttagtaggaggattagatacacccacaaaaggagaaatttttataaaagggaaagatatttcaaaactaaaaaaggaagaacaaactatatttagaagaagatatattggatttgtatttcaaaattatagtttaatgccagtactaaatgtatatgataatgttgtgcttcctattagctttgacaaaggtcaagggattaatcatgaatatatcaaaagcttattaaccgaattgggactatgggataaacgaaagaaatatccatatgaattgtctggaggacagcaacagcgtgttgcaattgcaagggcattagcaaataaaccggctataatcttagctgatgaaccaactggtaatttggattcaaaaacaacctcagaagtaattggtgttttaaaaagtagttctcataaatacaatcaaacaataataatggtaactcataatgaggttcttgctcaggcatgcgatcgtattctgagaattgaagatggtattttgagaaaggttggtgagcaagatgtttaaattagctcgaaaatatattgtgttttacaaaagccaatctttagcgattttagtaagtatgatattatcaattgctcttatgaccgggattagttccttagtatatagcggacaattaagcgatttacaaaacagtaaagagataaatggtgattggaattatgcagttcctctaaaggataatacaattgagaaaattacaaataagcaggataagggatataaagtagaaaaatatggtatctgtcaaactgttgatgaagcagtcagtgataaaaatattgctttattgtatggcgatgaaacatatttaaaaatgacaaatcaatttatcttagaaggggaatatcctaacaaagaaaatgaaattgctatgagtaaatttgttctagataatattggatatgatgatgttcttgggacgaggatatctttagacggtaaggaatatgtactttctggagttttgaaaagtgaatgggccgcagactcaaacatcttgaatgcatttataagcaaagaagaagttaacaagaaaggaggaatatcttcctttgtatatttgaaacttgatgaatcaaaaaagatgtataaacaaagtcaagctttgaaagaagaacttgaactagattcagaagcaatacaagaaaatgataatgtaaattattatttaggaggtgaaagtccacaaagtttaattgatcatcttaaatttgcttttactaatccagaaggaaattttacttacctaatgttagtgttacgcgatgaatttggtcttactgtaaatggcgtaatattagggcttggattgtttagcatttttattatatattctatatttagtgtaaatatatcaaaaagactttcacaatatggcatactaaaagtattaggaataggaagactaaaacaattttccttagttttatttgaactatggagtttactattggttgcgtttcctactggagttattcttggaaacttagtagctaaactcatgtatagtaactttaatacagtttttataaacaaagacgttgttaattctgaaacgcatataaacgggacacaaagttttttggctgctacggaattgaaagctgagaattttcatattagttataccgcaataatgtttgaagctatttttttagcagtagctatgtgctttatagcatggaaaattaaatgccaaactcaaaaaggagtatctattcaattattgaaaggtgaaaatgataaaaagagaaaaaatcgtacaatttacagtaaagggaaaatatctctatttaatgttttaatagagaaatttatgcttgagagaaaaagaacatttttaggaattttgatttcattatcacttggaggtgtgattttcttatgttccaattttgttttaacaaatgcacagactagcaataaaatgcaactggcatctgatgatgggctaggttcagattataaaatatatgagaataatatagacttaaacaagactataggagaagatattgagaatgagctagagaaaatagatggcgtaaaaaatgtatatccggtaaaaagttatataggagaagtattaattgaaaaaaataactttttctggaaagaatattatgaatatctgaatgaggcatataaggatacttacaatggctatatgagaaacacgataaacggagattacgctataaaatgcaatattctaggttataatgatgagttattgggaaaaatggagccatatattttagaaggaagtattgatccagatcaaatgcgtaggaataatgaaattgttctcgtaacattggaagacgcccaaggtaaccataacagcgttgataaaaagataggagacacaattaaagtaagaattccaaacaatataggtggtacttcagaagatttgaagcaacttggaagtgagtcggattttagtgaaaaagagtatactatttcagctattgtgagtagaacaatggtaagagatagtcgattatatactttagaagatcaaccagatataacctatagtgttattatgactaacgaacagatgcaaaaaaactataatattgaagcatatagagttttaactgtagaaaaggaaaaaagtgctgatacagaattagtagcagccgaaataaagagacggactcagacacttgatgattgcttgtttcaagattatacaggtgcaattgaacgacaaaatgaatttttgtttcaaaaaacattgtttttttatggaattgcttttgtttttttgattataagtctatttcatatagttaatacaatgaatcatctgatatcatctcgcaggcatgaatacggaattctaagagcgatgggaataacaaacaaaaattttagaaagctaatgttaggtcaaggcgctttgtatggtgttttttcaagcatagttatgattttattatatatcatagggaataaaactatggaatatttgatggggcatgtttatggattcctggttagtaatattcaagtgaatgtgtggttgataatagcaactgtagctgtaaatatttgcataggtatatttgcagttcttattccaacacattctatactaaaagaagatatcgtacggcaagtgaatttgacataaataagagactaatgtatataccggtcagtgtgctcatactgagcggtatatacaactaagagtttcaattaattaagttagtgcaaagaattggtgagtttagtaaaagaatgagtaatccgcacccgattgagccgcctgtccggacgacttgagccaatgttctgttttaaactgagccaccattccggcgaaaattgagccactttctgatgtgacctttataatgaatacagacgcaacgatgcgccaaatttattcaaaggtaagtacgtaatcatccgtaccttgattttcaaaacaaataagccgcccatcgggcggcacattttatttcttctttttggttcgaaattcttccagtaattcatctgaccatggtaaaagccgatttagatcatccggctttggaaaaggtcccattttacgaagctcgtctaatacataggaaagatatacatatggcttcagtccattcagcagggcagtttcagcgatactgtaaacaactgcgctggcatctgcgccacggatactcttggcaaacagccaatttcggcggcctactgcaaaatttttgattgcacgctccgcactattattatcaatgctcagatgcccatcatccaagtacctgcgaagatagttttcctgattcagcgtatataaaatggcatcaccaataagggaagatctgtctacagaatcttccatcgaatgtagccattcaaacagggcatccaccactggacgtgactgtttctgacgttcctgataccgttcttccgccgtcttatctttgatcagttcctctactttatacaggattccgatcctcgtcattgcctgatatgcaacggtttctttcagctgctcttttgtgaaatccttttttaatgccgtaagtgcggcatcgaagcgacgtctggcatgggtaaagaaccctgttacgataatggaatcgttcagtccatgatatgcctgatatccatcgcaggtcagatatccatgaaatgtgtctccaaggaaagtttaccgggtgatatccgccacgtgttctctcataatcaaaaagaaccatctgtggggcttcactattacggtctgtcagatatacccacatccagttttgggatgatcctttctgatccggttcatcaattacctgcatcctggtctcatcacaatggatgtatctgctctttaagaattcttccttcatctgcccataaagcagtcccagatactggtctgcacagcttcggagtaagtgaaagaccatcacaaagtcaatgcatttctttcagggttactttctgtaattcatccggagtatccggccagtgaaaggaatccctgtcaagcctcttcatcagaatccagaaaccggatccgtcccattgcagaatcttaatagaagttcgcctgcggttgcagaacgcaaacatgcagcgcgaatagggatcgagtttgaatttcagcttgataattgcagccagtccgtgatagctttttcttaaatccgtagctccacaggcaaggtaaacggttgtgccacctgccagatcaagcatgatctttcagtccctgtatgagaacatgaaaaagttccggtgggcattccggcatcacttcgatccgaatagcgtttgtgataaaaatgcggactggagacgggctgatgttcaaagtctcattctttgaaatttccgtttccgttggcatctttgcaaaaatcatatcagtatccgattgttcgtccaatgttttcagcttgcgcatccagtaattcattgtagagactggaatgcgatgttcctgacaccatgttttgcaagtctgcccactggattgaaattcatggattcgttcagaccacagtgtgattttttcatcttttttcataatgatacagtttccttcctttgttatgaaaaaagtgtatcagaaaaatatgggtgctaacagatacggatgattacgtacttacaaatcaatcacatcatcagtcggcagaaacacgcctgcaagagtgggcagcgcagatcaggaaatgtcaaaacagacttcctggaatatctgtaaaagaatggtgtgggcggcacgatgtaaccgtagttgattattccggtgcgcttggttcttctgcgagcctgtatcattcaaacttcgtatacattagtcttgctgctaaaagtgttttgtaacatcttccgtacatagtacgttttaccatttttaatttactatttgtctcctcaacaaaaccatttgaaagttcactagcaacagaattgttaacagcttctatatcctttcctaatccatttgcaaactgggatatctcttttaaatcagagtttttgtaccgttctataaacaaatacaatggtatacttttcttttcgtatacttcacgaaattctcgaacacaatgtattaattctttgagtttaggatatttctgtaaaatatatgccttatgatttgcactaagttccactcccatcccaagatacggaatatgccgtttcgtgaaaggtggtcatatttttgtaatgcctttttgttttggattgcttcaggtgaagaacttttataaattgcaacatcaatttggaatagttctatgattttacacatatggtcatatgctgcagattgaacgcccttatatcctttttcaataacattgtgatatacatcttttcgactgatgccagaagttaaagttttgataatataatcataaaactgatccattccgttgcaaaaatttttttgcaaagtgcttcatattctccactgagatattttgttacggtgtttctgctgccgaaatgcaatactttagaaatttggcgtttaccgtatctggcagagttgtattcctttatcgcagtgtacagtcgtaccctttttgattatattcgttaaagttatccacactgcatggtatttattttactaccgttttcaactgatggttctgctgttagaatcagatgggattctgatatcaacgggaaatacagaatttatagtatttcttatggcctctaataaattttgatgaagatgaaatctgtcagcaatctgcatagcaccgggtaaatccttcacagcttgtttccaatgccaaagtacatataaaagcttcgcgacgctccgtcatacggctttaaaaaaaccatttacattttctgcaaatgtggtaatagcgcaagacggattctcacattgatattcatgagcatttacaagcagatatgttgttttacctaaaataggaagatcctgaacttttcttttataagtacccctgtgtttgtgtcctgaaaccactccgcactttggacaagtgcaatttttgaacgaacaaaaattttaagatgaatctccttatctttttgaataatatgtgatacatccattcagtaggataaaatttttgtaaatccaggttattttccgttcaactcaaatctattccctccacgatataatcaataccatgattttagcattcaaatgtaaatatttcaactattttacggataattgcggaagaatccttttgaagcggaatatccaactggttgataattattgtttcgtaatggtcatcttttactgtgggaatactcaaatttagaaaaaattacataaagagtcgtatttataccatgacagaaaagtgaaataaatttactgttataattcgtgataaggatagcgaggaggtcaaatatatgaaatgggcaaaaaatataaaggttcttactcgaggtacaaaagttcttattgctaatttaaataatgggaaatgggttaggacgagtaatgaagcctatgcattaatcaaaaatatgctatcagagaattttgatattggagatcttatttttgaagaaccagatgataaaaaatatattgaagaagcaatagaggctctaatggaatgtcaattacttgttgatagtaagacaacagagactgacataaagaaaaatatttctatagagcttacaaataattgtaatttacactgtgtacattgttgcgtagaggctggagaaaaaaggaaaaaagatttatctactgaagaaatcatagacatttttaataaatgcatttcatggaatcctaaaatgattactttaagcggaggagagccattactaagaaaagacttcaaagaattattagtgtatttacgaagcaattacaatggacatataggcgtatcaacaaatggtactttgattacaaacagcaatgctgatttacttgtaaaatatgctgatcaaatcgatattagtatagatggtgtagatgaagaaacatgcagtattgtcagagggaaaggtgtttttgaaaatgtaataaggaatattaaagttcttcaagataaaggctttaacaatgtttcattatcgatggtattttcagataagaatgaatatttagaaccagcatttttagaattaaatagacaattaggaactactccgattacacgtgtgtttgctgaaattggaagaggaaaagattccaaaaatatattttccgataaaggtattgatgacgtatacattccagagacttttttagatttgaatagcaaacagcaattaggagtaagaacttgttctgcgggaagaaatcaattatttgttagatataatggagaagtttatccttgccctagttatatgaaaagagagtattgcttaggaaatattttaaaagttcagaaaattgatgaactattagttgatagcgaagggaaaaaggatattcaagaattaatgctaaaaactgatatgttatatggtaaaaaatgtgctaattgcgaactctcattattttgttggacatgtcctggagaagcatataatttaaaatctgaggctgcattagaaaagtattgcgaaacttgtaaaccgatgcttttacataaaatatggggggaataaaatggcagttggatatatgatttggctgactacagcttgtaacttgaaatgtaaatactgctacgagggaacagcaaaagttaattgttatttatcaaaagattatgcagcaaagatagtggattatatagtacaggactgtgataaaacgaaaaacttgcaaatttcttttcatggcggggaaccttttttaaactataaaataatggaattcattagtttagagcttgaaaatcaacttcattctgttgtaaacgatatttcatatcaagtaacaactaatgctacaattttaaatgaagaaattatagaatttttaaaagaccataaaattgaagtgacgtgtagccttgatggaacaaaggaaactcatgacagtatacgagtgtttgaagaaaataaaggaagttatgatatagcaatgaaaaatagtttaaaattgttagcgttatatccagacttaagagtaagaatgacggttagatcaacagaggtagaaaacttatcaaagaatattatatatttagtagaaaaaggatttaatctaattgtacctgtattagatttttacgacaaaaattggaatgaagaaaagtttgaaattataaaagaagaaataaaaaaggttaaaatatatgtaagaaacaaagatgtcactataagtcttttggaaccattgagtattaaaaagaagtcactgtgccaaggcggaatacaaactataaatatctatcctaatggggacatatatccatgtacacttgcagcaggcgataaagaatttttaatcggaaatattgaacaaggaataaattataaaaagttagaagaaatattatcttattctcagaaagaaaataaagaatgtagaggatgtgtattttataatttctgtaattccacacgatgcaaaatcataaataaattggttacaggagattacaattcgcctaatagcttagaatgcaatatgaatcatttactttatgaagagaatggttatttgtgttattaatttgctggctaatagtttgtaatgcaaacaatattttatcgtttgtttacaatataattctaggaaaggagatgaaaactatgaagatcagaaagatggaaaacaaggaattaaaaaaggttgtaggacagtgctgctgtaagattgtaggaaaaccgtcagtctatgaaacagattcctgctgcctggctgactgtaaaaaagatggccgtgatacagcacattatacaatctatcactaggaggaaaccaacatgaaaatcagaaaaatggaaaataaggaactgaaaaaagtaactggacagtgttgctgcaagattgtaggaaaaccgtcagtctatgaaacagattcctgctgcctggctgactgtaaaaaagatggccgtgatacagcacattatacaatctatcactaggaggaaaccaacatgaaaatcagaaaaatggaaaataaggaactgaaaaaagtaactggacagtgttgctgcaagattgtaggaaaaccgtcagtctatgaaacagattcctgctgcctggctgactgtaaaaaagatggccgtgatacagcacattatacaatctatcactaggaggaaaccaacatgaaattagaaaaatggaaaataaagaactgaaaaaagtaactggacagtgttgttgcaagattgtaggaaaaccgtcagtctatgaaacagattcccgctgcctggctgactgtaaaaaagatggtcgtgatacagcacatgttacgatttaccactaagcgggaattaatatgaagattagaaagatgaaaaacaaggaattaaaaaaagttattgggcagtgttgctgcagagtacagggaaagccggcaatttatgaccctaattcttgttgtttgagtgattgcacacgttttgataaacctgcatcatatgtttcaccactgcattaatcacttctaataaaaaaaaactaaagtaaggaaggggctatcgttatagattcattgtttgagcatgaagatataacgatggcctttattaaaaaaatgagaaaagtaacgattgcaataatagattcaggtatagacaaccgttttaagaaccagtttaaatgtaaagtttcaggaattggtgtgacattaataaataatgaaattaaaattgttgaggattatttcgatgaaaatggacatgggacattaacagcatctgttattatcaacgagtgtcctgatattgaattcttcattataaaaatattagacagaaaactagagggaaatatcgaatgccttatcgctagcttagaatatttattagataaagatgtaaatattattaacatgagtttggcagttgagaaaaatggaagagatagcaggttaaaaaaaatatgtaaaaggttaaatgatcaaggcaaaattttaatagctgctgttgaaaatgggagcaagaaaagtattccggcaatttatagtactgttattgcagttgaaggaagaaaattaaaacagaattttgactttatgttttcttcaaataaaagaattaactgcgttatacgaagtgagccgcatttatattatcagaaaaaagatgattatgttatgtatggagattgtaatagctttgctgcagcaaaactttctgggaaactagcaagaatattacggaagcaacctagcaatgacaattcgaaagtaaaaaaattattaagaaaagaatcaaaattatttgtttggacggttccgcttcttaatttgtttaaagaatatccagtttttagagataataatattatttatgatccgataaaattaaataaattagcaacaaatattgcggtgtttttttctgtagaaaatatttcagatatttattcgtattctttgtatagttcgaaaattagccaaaaaaaagaattcgcttatagattccttcgctttttggaagaaaagtatggatttgtttgtgaaaattatagcgtttttgagagaaatgattttatatctatatattctgtatataaattcttgaaggagagatacaaatggtagaatttaaagagtatgttatatatatatttaaagaaaataaaattaagtcactaatagtttttgtattaactttagtcgtaacaacgctaagtctactggaaccacagctattggtaattttagtagataaagctatttcgcacgataattttaatttactgtttattgtttctatatcctatgtaattttaatagttatttcggcattatgtaagtactctattacagtattgagaacaaaaattaaaaagcaaactacatataaaatgagaacgaaattgctgttacacatacaagaattaccgggtaaatattttacggaacagaaaacaggagatattttaaaagtaatcgatagtgatgtaagtgcattagaagagacgggaatagattttgttatagatattattaagaatttattatctgcaatatcggcttttgtgatattagcatgtataaatacgaaacttttacttattatgattttaatggagacatttatgttgtttttgcatgaaaaatatataaaacttgtctctaaaaaattggaaagagttagggatataagtggaaaatcaatgaatttattagaagaatttgtcgttcatatgatggatataataattacacatgcaaatatactcttcttgaaaaaatacttaaataatgagcagctttatattaatgaatccactaagttggaaaaaatgatagaaaaaaatcaattaacagcaaatacgcttaatgaaattatgtttatagtaatttatttaatcagtggactttcaattatacagaatactatgacaataggaacaatgatggcttttattcaatatacatcgatgttaatctctccaatattacaattaaccaattccaatacaagaatacatatagcaatcgtatctctcagaagaataagaactgttttgcgtattcccaaaacagttgatgttggaacgaaagaaaatatagaaggtaaaattcaatttgaaaatgtgaatttttcatatcaacctgaagtgaatgtattgaatgattttaatatgaaaattgagaaaggtaaaaaaatcgcaattgttggttgcagtgggtgtggaaaaagtactttgttaaaacttttatatagattatggagtccaaatcaagggaaaatacttattgatgatatacctatagaaaaatattcattaaaagctctgagagatagcatagcaattgttacacaggatgtgatgatatttaatgatacagttttaaataatataaatttaacaggggataggaatatttctgaaatcaaaaaaatgtgtaagaaaatagatctagaggataatgccattcttatggatgaaaacccagagggaacagttggggagtatggagtgaaattgtcaggaggacaaaaacaaagaatagcaattttgcgtgcaattttacagaatgcatccatttatgtttttgatgaagcaacttctgctttagataatctaacacaggaaaaaataatggaagagattgatacatacttatgcggaaaaacaaccattataattgcacataggctttcgacagttagaaacgcagattatatatatgttatagaaaacggtagtgttgttgaagagggaacacatgataagttaatgttaaaaaacggagcgtataagaaaatgtatatgagtgagatatagttatgttttatgttgcgagaggatgttgttgatgactaagaatgtgtcactgccaaaaaagggtgccagattttttcactactagtgggacttcgaaattttcagttttctccgagtatctggtcacggactttcagctctgttagttccctaactcgcatagcagtatcatatccaagaataaggagcaactggttccgatgtttgggatatttcctttaccaactcttcgggatttacgtttttattgttgtttatatcgccacctgtagatgtttgtagatttgtgtggggggtgtgtgtaacaaacttgcaaagttcagatgaaataaaagttactttaacacaggaaacaattacatagaaaagattgtcataattttttcgttggcggtaagtttgaaacaaagagatagtggttagagaaaaagtaaatcgcatagcaaacaagccatctttcggtggcttttcaaaaaggtaaatatagacacgacacctaattcatagccggagtaacatcatccttgatagtatatccacgctgttttagtagattaagagcctgtgaagtggtcagtatttttgtgattcattcacaggacgtaattcaagaaagccctctgctgagtatggcttcaaatcagagagtatgtgccagataacggtcaggagcatacgacagattgcaatgatggctttcttgtgaccacggtgcgattttatgcgcttatagcggtcggttatttcgggatgtttcttggaactcaatggcgaatttcagcaggtggaataaaggaaggtttaatcatttcacacatgaataaatcacaaattcatttcgcatcctttcggtcagtcttgtttcctttttgtagtttcgtatatttgggatgagcaagaataacagaaatatttgctttttccaaaatattaaatacagggatccaatacttgctggtagattccatacaaacttcagaacaattgtattttgcaagctaatcacacagttccttcaaacctttggaaaaagaagagaaacgagcttgcttgtaatcagttctgccctttgaatcagtgataccgatgcaagcataaatccatgttttgtggacatcaagcccacagcaattaaaacgaaaaattttgaaagccaataaaataacctcctgattttgtagtaataaaactgacaatgactggtcatctggcaaaatcgagtcgactttggaagagataagtttacgggctacgttatgcaccattcattgatgccttaacggatgaccgatgacatatatatgtgaacttccactgatttgtacaactaaatatataaataccccataattttaagctttttggggaatatggtgtaattttattaatgcgtatttacgactactggttcacctatatttccacagaaaatccagtatttatgcgggcaaatcgattttagtcgtaaatttattggaagttcacagtttcataaccccatcagtgcctttcgcaggggaaaggcggaatatatatggataatggagccagtggataaaatacagtaattgattacttctattatttgtatcataagaacctttttaaggtagcatatatctataatatgtttaagaggtaaccaattatggagagtcgtatcaaacaacttcgtgaaaatagagggctgatacaggaaattttggcttctgaattaggaattacacaacaaatgcttagtaaatatgaaagagatgtgttgtgtattaaagtggatgtgttaaagaggatagccgaatattttaatgtgacaacggattatttactgggagtttcagaagtgaagagagatttgcaaggacagatgaaagtgaacaagacattagacacctattatgatcttatcgagatatataaaggtttagatgagtatgatcaggaaatggtatggtcaattatgcaaacggtaaaaaaaactggtgaaaaacgtaaaagagacagggaaaatacagaagagagttgataagaaatgctgaatatagcaatttgtgatgatgatattcagacaaccggaagaatggatatgctgttgcaggaaatagcaaagcgaaattttatggatgttgaaattgaagtgttttggaatggaaagagtcttgcagatgcagttgcaaaggggacttattttgacatgatttatttggatatagaaatggacaaagaagatgggatttcggcagctaaaagaattagagcctatgataaaaacgttcttattatttatgttacaagccacgaaaatcatatgcaggagtcttttgaagtcagaccgtttcgtttccttgtgaagccagtgagtgaaaaacagattgaatcgtgttttaaatcagcatacgaagaagtgtattgcggagattcgtattttcggtatagctatcagagggtaaaccataaaataccaattcgtgaaattttgtactttgagagcaataaacgtaaagtatttattgtgacggaaaaagatacatttgtcgcatatggaaaattaaatgatatagaggaaagtcttaaacaaagcaaagtgccatttttacgtgttcatcagtcatatcttgtaaattataagcatgtggaagggcaggcatatgatttcgtagttatggataatggcaaaagaatttcaatcagtgaagacagaagaaaattaatcggagagcagtactgctcaatggaggacacattttatgtcaatgagtaagacattgtcatatggagttgatatattgtttatcatatttgcagcatacctgttcttttgttatttcgatatatttttaaaaagaagaaaaagaacagttttgtcagtggttggattggtagcatttatggcatggcaatttgaaatgtcgagcgttaatttgctaccagcttatggcaatattattattacgagtatcactacattgtttgcggttgctcaaacttatgagggaaaattttggaacaaatgtatttttacaattgcttttaatgcaatctggatgttaatggaaacattaagcaattatatgcttatgacctattgcgaacaatatgcagaatctgaagcattgggttcggttacttcaaaattgattttcttgataataattgtggcattgaaaaaagtgtttactgatgatgaaatcaaggaattacctgtaagatatagtattatgtttgttttgattccaacgggaagtatttacattatgaacaatatttttatgcttggatataaagttcatagcaaccgggcaagtttccattctgcaattacggcggttattcttttgttcatgaacatattgatattttatatttatatgaaattggcagatgatctgcagctaagaagaataacctctgtttatgaacaacaattagatttgtgtgaacggcatcagcaagagagagaactgtcaatacttcaattaagagatgtaagacataatatgaaaaacaatcttgtgtcgattcttgcatatgcggaaaacggagataatgaaaaaatcatcggatttgtcaatgaaataatggaagaaggtggaataaagacatctgcagttacaaacagtggaaatattgttatagattcactgattggatattggtatgttgcagcaaagaaagctggtatagagttttccgtcaatttaaatattcctatggaaatgccgtttagaggagcggatatttgcctaatacttggcaatttattagaaaatgctgtagaagcaacacaaagagcagagggtgaaaagtacattagacttcacatgaaatatgataaaaataatctgctgttatttgtggaaaataattacaaaggtgtgcttataaagacgaaagataaaaggttaaagtctacaaaaacagatgctggaaatcatggtgtaggtattccgtctgtatatcgaattgctgcaaaatatcatggagtggttacgattgatgataatgtggcaaatcgttttttgatcagagtagtgttatacggaaagcagaaataattacattaatagtcggtattattacattatgcttagcattatgggaaaaagagataaaataaaaagataattttagggaaatggtgaatgctttttagaatggtattgtggtggtgcagtatgatggaagtgttattattcagtaatgatgaaaagatttttaatttgacaaatagtgtaatagatggaagatataaattaacatggtgtacttataagtctttagaaaaaaaaacatgtccatatccatatccagatatagttattatgcactttgataaagagatggttaagaaagggacatttaaaacaattgttcaggtaaaggggagactagggcaaaggataccaatccttgcgctgatggaagaaggaacaccgcaaaatattttttcaacattaatagcgggtgcctatgattatttagaaattgtgaaaaattcaaaagaatataaaaagaaaatagaggatgctatccggtggaattggtatctgggaaagtatggactgagagaaaaatagtagtgatattgaacgtcactactatttttgcgttacatgaaaaaaggagaaagagcagtttcagaaaaagttacatgaatactcgttttttttacaagaaagatatattggctgatttttgtagtagtgtaaaggaaacaaatgaaaggagattcaaatcatgaattctaaaaaagtaaaaaatcagtcagcaaaagtattggcaaacgtatctctgaaactcggcaaaatgtcagcagatagtgcgtgctgctatatttatcatcagcctaaaatgccggaagccctgaaaaaaatgaaaaatatttaatatgaaatatttttcggagaaactgacaggttatattgttaaatctggtgctgttccagaggaatcatatgaaatataccaatatgggtttcaaataggacttgaaatgttgagctgtcttttagcttgttttggaattgcggtatatttgcatatgattccggaatttgcagtggttacaggaatttttatgatgttacgcagttttgttggcggagtgcatctaaacagctttagtgcctgctttatgtgttctgttactgtgcagacgttggtattggttgttaatcgtctgtatacacaaccattaaatgctgcgtggggaataattgtgttgagcagtattctgatatggaatatggctccggtacaaagcattaaccgggaacttgatgcagatgaaaaaagacactgcagaaaggtagctgtaaaaattattgcgggcatatatgtgtttgcggggatttgtacacttactgggatgaaagcaatagtgtctttggttgcagtgacaatggcagtagttttgatttcacaatatattggggtagtaaagtataaaatagaaaagagataataagcgggaatagtagaaatctattatttccgcttattttatttgaggacaaaagaattgtttattttttctaggtaacactgttttggtaataaaaaatgtctgctaggcttcggctcaggaggcgcttcttgttataaggataaaaaaattcttccagacccgaagatgggggactttctatacgagatatgggtgaaagggaaaaaacctttactcatatcttgtggacgggaaggcggtgaactctatggagcaatcttctttctatgatgaaacaacggtcagacatcagtttgataggaaatgcaaactggcactggatgacgaagtggtagattatgacaggcatatggattaccggagaaagaatgaagtactgttttcgaaattatctgaatgccaggcaggagaattttcggtgttggatgaatataatctggaaatatattgacttcaagtaatgagttaggacattgaagtaaaagatgggttgattgttgagactctgcgaattctcataaaaagaagcgaaatgtaatttttctgttgtattttccaggcacacaaaggagcagtacatattttaaagaaaaatacaaaagaaaagagtctaacttaagaaagagcgtttggtggtgtcacaattctagataggattgcggcacttttcttttcgacaaaattcgaagcaggtttacagaataaagccagagcgccaccacattccgatttgatttcaaaaattcagatcggaggttaagaaaagatgacttttaataaagcaaaggcggagaaacaatggctgaaatggaaagaaacagaagaggaaaagcttcggcaactcggaatggacgaagaatcaataagaaaacttcggcagatggattgggaagatttcaaggaggaacgcagatactgggaacatttcgtagaaagcagaggagaagcaactggggagaaaagaagtttccttattaaaacgcttatagaaggaaaggaatgcggaaatgaaatacgataaaatagttgccatgaatcaagaaaagagtaggaaaaaagtggacgtgctaaaagagaaatgaagaagataaaggagtatgcagaacgaggatacactcatgcggtggcacttgatttgtcgaaatactttgatacactcaaccacgaaaagctcctaaatctgttacgtagagatataaaagatgaaagagtgatacagtggattaagagatatctgaaaagtggtgttatggagaacggagtagtcatggaaacagaagaaggttcgccacagggtggaaatatctcgccattgttagcgaacatctatctgaatgagttcgaccaagagtatgagaaacgcggagttaaatttgtcagatatgcagatgatatcgttcttcttgcaaagagtgacagagccgcaaaacgattacttgaaacaagcacgaaatatcttgaaggaacactgaaattaaaggtgaaccaagagaaaagtcgagtggtcagtgtgtttgcaatccgaaattttaagtaccttggcttcacattgggaaagaacggaaagggtatctatatccgcgttcatgggaagtcatggaagaaaatgaagtcaaagctgaaagaacttagttcccgaaggtcttgccagagtatacgcccatcactacaagagataaaagagtatatgcgagggtggctgaattattatggggttgcagatatgaagaagaaaatagatgatttaaataaatggctatatcacagaatccgtatgtgcatctggaaacaatggaagaaaccgaagacaaagataagaaatctgctaaagatgggagtaccaaaggacttggcatggcaagcaggaaacagtcgcagaggatattggtttgtgactcatacgatagcggtcaatttagcaatgacaaaagaaagactgataaacagtggcttttatgatttagccaccgcctatcagtctgtgcacgtcaactattgaaagcgccgtgtaccgaacgatacgcacggtgctgtgagaggacgggagttagtcactccctcctactcgattaaattacggcattgtcgtctaatcattcttcaatggaaccaaatactatctttgtaacagaaacgctcttgggtgctgacatattttttactggaaaataagaggaaaattagctataatcgtagtaagagctaggggagaagaaacaacaggaatatataatgtgcgaaggaggaacgctatgaaatggaaagggcgaagactgcttgccatggcacttaccggtatcttgcttgcaggatgcggggcagccggacaggtcgatgattatgcaacgaatgagggaagtacacaggaggcttccaccaaaacaacgggaactgaaagcggagggatttcaaaggacaagatcaaggtaggggttttacacttatcggatccggcagaaggcagtggatatacctatacacatgatcttggcattcaggcaatgcagcagaatcttggattatcagatgaacagattgacagaaaaataaatgttgatgattccgataaagaggcaaccgaaaaagcgattcaggagtgtgtggatgatggatgcaatattatttttaccaccagctggggatatatggatgccacggaggagatggcggaaaaatatccggatatatattttgcacatggaacaggatacaaaagcaacggaaagaattttgtaaactatttcgggcgaatctatcaggcaagatatttaagcggaatcgtagcgggaatgaataccaaaaccaataagctgggatatgtggcagcgatggattcctccaattccgaagtgacaggaggtattgatgcctttgcacttggggtgtattccgtgaaaccggaagcaaaaatctatgtaaaagtcacgaacagctggtttgacccggatgcggagaaagcagcagcacaaaccctgttaaatatggactgtgatgtggtcacgcagcactgtgatacagaatatccacagacaatggcacaggaaaaaggggtgtatggtatcgggtacaattccgatatgagcaaaaatgctccggatgcctgtctgtgcagcgtgatctggaactggggtgcttattatacagcagcggtgcagagcgtgattgacggtacctgggatggaagcaattattatggcggtatgaatgaaaatctggtagggattacgtcactttctgatttttgcacagatggaacacaggaggctgtggatactgcaaaagaagatattttatccgggaaaaacggtgtgtttgacggtgtgattgaaacaaataccggggaaacggttggtgaagaaggaaaaacgctggatgatgccacaattacaggtggaatcaactggtattttaaaaccgttgaagtggtagaatagggggcatatatgagtatacgaaagaaaattcttgcaatcagcatagggccggtgctggtattaggggtaattaccctgctttttatacttacgatggttaaaagctccctgatggatgaggtacaggatgcattaaaaggtaccgcggcagccacccttgccgcttatgaccagaataccggggattatctggaaagtaccaatggggatatctggaaaggaagctataatatatcaaagtcggagagtcttgtggaccggatcaaagagaataccggtatggatgtaacctttttttatggaaacaaaaggattatgacatctgcactggataaaaaaggaaaccgtatccttggttcagaagccggagagcgtgtggtgaatcaggtgatcaaagggaaaaagccgtttttcagtacaaatgtttcactggatgggacgagaaattatggatattttattccagtgtatcagaatggaacgacagatcaggttatcggtatggtgtttgtcggaaccaataaggcacaaaaagatgcaattgtcaataaaatccttggaagtattatgatggcattgcttgtagtgatgcttttgtgcattgttacggcgatgcgcatggcagcctctatcagtaaaaatatcaaaaacagtgttgctgttgtaggaaaacttgcagatggtgatttaaatgtgtgggtagatgaaaaacttctgaaacgaaaggatgagatcggtgatctgtctcgcggaaccatgacattaagggatgccatgaagtccgtaatccgggatatttcagaaaatgcaaagcagctgctttcaacgtcacagattctgggtacggcagcagacaacaccaatggaacaatgtcacaggtacagcaggcggtcagccttgtagtggataattccagtgagcaggcgaaaaattcgagaaatacttcggatcatatgaaaattatgggggagaatatcacggaaactacagcagaggtacaaaatctggatcaaaatgccacatttatgcattcttccagcgaaaatgcttccgcaacgctggaaaaactctgtgggatcaatgaacaggtggagcagatgctggcacaggttcagcagcagaccgaccggacaaacgattctgtacagaagatccagcaggccacaaccatcatttcttctattgcagaggaaaccaatctgctgagcctgaatgcctccattgaagctgcccgggcgggagaaagcggccgcggattcgctgtggtggcaggtcagattaaaaaacttgcagagcaatcggatcagtcgagtcaggaaattgagcagatagcgtcaacgctgatcagggattcttcccttgctgtggaaagtatgcagagtatgcagcagattattaccagccagagtgagagcatggcagaaacgcagaatattgtaaaagaagtgctgggcgaaattaacagttccatgcagagcatcaaacagatcaaagcaagtaccagacgtctggaagattccagaaatgaagtcgttcaggcagttggggaattgtccggaattgcggaagaaaatgtggaaagcacgaaaaaaacctacgatggaacacaggaagttgtgggaacgttccagcaggtatatgtaagtgccgagcagttgcgtgagatttctgataaactggtaaaaggaatcgggtattttcatatttaaagaaacacagagtgtcggaaaattccggcactctttttatgtcatgaatctggtataaatcctgtgattctgatattcataaatttgtaaatccgttacaatggggtaaaaggcttgaaaattgaaaggttggaggtttcacatgaattttggatattttgatgatgagaaaagagagtatgtaatcacacgcccggatacaccggcgccgtgggcgaattatctggggtcaccggagtatggtgcgctgatttcaaataatgcaggaggatacagttttgccagatctggtgcaaacggaagaatcctgcgttatatttttaaccagtttgatcagccgggacgctatatttatctgcgggataatgagagcaaagactactggtctgcatcctggcagccggtaggaaaagatctggaaagttataaaagtgagtgtcatcatggaacagcatacacaaagatgcttgcagattacagtggaatccattctgaagtatgttattatgtgccgttgaatcagacatatgaggtctggcatctgaaagtgaccaatgcgtcagcgtgtgaaagaaacctgaccatcaccggttatgcggaatttaccaacaacaataattatgaacaggatcaggtaaatctgcagtattcccagttcatcacgagtacggtatttgagacaaaccgtatccggcatattattcacggtaatctggactgggtgaaagaaggagaggaagtggataacaagcttgcaatctcccgtttctttgcactgaccggtgcaccggtggacagttactgtggagataaagaatcgtttcttggacgctatcacggatatcataatccggtgggggtggaaaacggaaaattatccggggaaatgtgctacaacgaaaacgggtgcggagcactggcagctcagatgcttctgaaaccgggagaaacaaaggaaattgcatttcttgtcggaatgaaagaacatgaggaagcagaagcaatctgtaaccgctatgcagatgtggcagcacagtgtgagacggaactgaaagaactgacgggctactggcatgaaaaactggaacattttcaggtacatacaccaagcagggaatttgataccatgatcaatacctggaacgcatacaattgttttatgacattcatctggtcacgtgcggcgtcgtttttctactgtggtctgcgaaacggttacggataccgcgataccgtgcaggatattcagggtgtgattcatcttgcaccggagatggcactcgaaaagatccggtttatgctttcggcacaggtggataacggaggaggacttccacttgtcaaatttacacacaatgccggacatgaggatacgccggatgatgcttcctatgtacaggaaaccgggcatccggcatatcgtgcggatgatgctctgtggctgtttccaacggtatataaatatattgcggagtccggaaatctggcatttatcgatgaagtgattccgtttgccaataaagatgaagccactgtatacgagcacttgaagagagcacttgcgttttctgtgaatcatctgggaccgcacggacttccggcaggactttatgcggactggaatgactgtctgcgtctgggcaaaaatggagagtcctcgtttgttgcactgcagttttattatgcaatgacgattttaaaacagtttgccgcatacaaagaagatcaggcatatatggattatctggaagaagaacagaaaaaacttggaacattaattaacaatctctgctggaatgaggatcgttttatccgtggatttacggaagccggagaggtgattggaaaacgcacggatccggaagcaaatatgtggctgaatccacagagctgggctgtgatcagtggactggcaacaaagcagcaggcagaactttccatggaaaatgtaagaaagcggttaaacacagagtatggagcgattctgatggacccaccatatcatctgcatgcatttgacggagcactggctgtgatttacaatcccggtacaaaagaaaatgccggtatcttttcccagtcgcagggatggctgattctggcagaagcattgctggggcatggggatcaggcatttacctattttatggaaaatgcaccgtctgcacagaacgatcgtgctgagatccggaaactggagccatactgttatggacagtttacggaaggaaaagacagcccgcattttggtcgttcccatgtgcactggctgaccggaactgcttccactgtaatggtaggatgtgtggaaggaatccttggcatgcgtccggactttggaggacttcgtattgcaccatccattccggcggactgggatcagtttaccattgagaaggatttccggggaaaacatcttcatattgtggtagaaaatccagagcatgtacagagtggatgcaaagcgttgtacgtgaatgaggaaaagatggaagacaactacattccggtagaaaaaatgaccgatcagacgaaggtacgccttgtgatggcatagaagggagaagttatgaaaaacgatatgcagtttacaggaaaaaacggagaatttcaaatccgtcatatggttgaaaaaacacagctcaattttccggtggcaaatgaagaaggaatcaaaagcagcgtgacgcagaccttcggcggcgattgtaagctggatcagaaccattttctgctggaaccggtgagcatcgaaaatctgcacaataacagaagtacccgcaatgtctggtgtacaatcaaccggaaggaacatgtgtcactgaccggagtttcggcgcaggcagaatatgcacatttccttggaaaagaggaggaagtgacattcgatgccggatttatgtggcaggagacgaagcgggaattaaaagaacagaaaatcgaggcagccgtgcggatctttgctccgcttggagtaccggcagaactgatgcaggtgcgcgttaccaataaatcggatatggatatgtgtgtgcgcgtgacttctgctatcccaatttacggcagaagcgcggataatctgcgcgatcaccgccatgtaacttccctgcttcaccggatccgtactaccggacgcggcgtgatctgtaaaccggtattgtcatttgatgaacgcggacatcagaaaaatcatatgatttattttgagatgggcagtcagggagatggaacaaaaccggaatcgttcttcccaacggtggaatcgtttatcggagaaaccggaacatttctggcaccggatgcgcttaaaaataaagaaaaaggctgtccggccggttgtaccgtggatggaaaagaagcaatgggggcgatggtatttccggagattacccttgcagcaggagcacatgtcgattatattctgcttggtggcatgacagaggatctgaagctggcagaacaggcagcagaaatgttttgcacgaccgaacaggcagatgctgcctttgaacaggcaaaaaattactggaatgggctggtcaatatttcctttgaaaccggaaaccccaaagaagacagttatctgaaatggatctgtttccagccggttcttcgcagaatctacggatgttcgtttttgccgtaccatgattatggcagaggcggcaggggctggcgtgatctgtggcaggattgtctctcccttctgattctcgacccgaaggaagttcgctccatgattttaaacagctttgcgggtgtccgttttgacgggaccaatgcgacaattatcggggataagccgggagaatttgttgcagaccgcaacaatattacaagagtctggatggatcatgcgtactggccgtttgttaccacaaaattgtatctgaaccagacgggagatctggatattctggatcagaaagtggcgtattttaaggacccacaggcaaagcgtggaactgccagggacgcagagtggacaccggcatatgggatgcgccagaaagatgtaaatggcaatatttacgagggcacggttttagaacatctgcttttgcagaatctgtgcgctttctacgaggcgggagaacatggaatgatgcgtcttcgcggtgctgactggaatgatgcactggatatggcagcggaaaaaggagaaagcgtggcttttacctgtgcgtatatcggaaatctccgtgatttggcagatacccttgaaaaatacgaagcggcaagcggaaagaaagagattacactggcaaaagagatggaaattctgatcagacaggaccgcacatcgtatgattcggcagaaaaacggaatgttgttttaaacaattatgtgagtcagtgtgtgcataatatttctggagaacagatttctgtggatatcagtactctggtgcagaatctgcgggagcgtgctgactggtataccggattgatccgtacgcaggaatgggtaacggatgaaaacggaaatggctggtttaacggatattatgataatcacggcagaccggtggaaggcaaaagggataatcatgtccgtatgatgctgaccggtcaggtattttctgttatgggaaatgtcgcagatgatgcacagaccgctgcgattataaaaagtgcagacctgtatctgtataaaaaagaggtgggaggctaccggctgaacacggattttaaggaagaaaaatttgatttgggacgaatgtttggatttgcttatggcgaaaaagaaaatggtgcggttttttcccatatgacggtgatgtatgcaaatgcattgtatcagagaggttttgtaaaggaaggatacaaggcattgtacactctgctcgaacaggccatgaacacaccggtgagcctgatgtatccaggaattccggaatattttgatgcggacggaaaaggcaaatatccgtatctgaccggggcagccagctggtatatgatgacaatggttacacagatttttggattccgcggagaatggggagatctggtactagaacccaaaattctgttgcggcagtttgacgaaagtggcaattattcggcacagttcccattccgtggacagacatacgcagtggtttaccagaatccacaaaagaaagaatatggggattaccggatcacggaagtatggctggatggtcagcggtatgccggagaaacaaatacaggcatctgcattccgtttgccgtacttgaaggaaaagaaaaccatacacttcggattgttctgggatagcagaattttaccatgtgcttttgtacttggaactgcggtattgttttggggtcataccgacatagtgctggaatgtctggataaaatgactctgggaagaaaatgataaatagtttgcaatctgaatgtaggtaaaatcggaaaagcgtagaagattctgcgctttttcgatttttttttcgcggatataatcactgatcgacacaccgaggttctgcttaaacaaccgggacagatagctggcagacaaattggtgcagaccgcaagatcttccacggtgattcttgcactgatgtgggcatagatataatcaatacactgtgcaactggtttggataatgcggtattcttctgcagaaggcgcatttttccggtgaagtcaagagccatctcatgatgcagatctgatatttcctgaatggtgctgcaggcatccatgtgaataatgtaaaaatcgctcagacggtaggcctgctctgtttccatgccgccgtcaatgcaataccgtgtgaccagtgcaacggtaataacaaaatgatattttaagtttgtcaggggatttttggaaagaattcccatgccttcgggattggtaaacgcttcttcctttaaatttttactgactgcttcgatgtttccgtcttttacggcttcaaaaaaggaatattcctcggaaagtgcacgatgatggatttcgtattcgctgtcttcgatttcttttttgctccattgatttttcagcatggcaagacctcctgtttatatctgtagattatgtcatgaatctgatatatttgcaagcatttttgtatcagaacccattggaaaactctataataaaaccatgcttaaggcagaaaagaaaaggaggaaatttactatgaaaaagaaagcagtcagtgcattattatgtgcagccatggtagcaggaatgcttgcaggttgcggaaaaggaagtgattccggtacaccgtcagatacatccaagggggatgcgtcaaacgcaacagaaagtgcttcatcaaatctgaaagatgatggaaaggtattaaatatttactgctggaacgaggagttcaagagccgtattaccgcacactatccggattacaaggaagtggatgcaacacacggaaaaatcggagatgtggatgttgtatggaacatcacaccgagtgatgacaatgcatatcagaacaacctggatgcagcactgttaaatcagcaggatgctccggcagatgacaagattgatatttttctggtagaagcggacaacgcattaaagtatgtagatacggattacacagcaccggtaaaagatcttggaattaccgatgcggatctttccaagcagtaccagtacacaaaggatatcgtaaccgattccaagggagtgttaaaaggagtttcatggcagggatgtccaggtgttcttttctataacagagaggctgcaaaggatgtactgggaaccgatgatccggatgaagtacagaattatgtatgtgactgggatactttcaatgatactgctgcaaaaatgcaggcaaaaggttacaagatgatttcatctgtaaatgatacataccgtgtatactccaacaatgtctcaagcaagtgggtagaagacggaaaagtacaggtagatgacaatatcatgaaatgggtggacgattccaagaaacttgtagatgcaaaagaggcaggaacctttgatatgtggtccgatgactggtcaaagggattctatccggacggaaaagtattctgctactttggaccggcatggcttgtaaacttctctatggcagctgataccgaaggatctatcggttacaacggcggatggggtgcagcccagggaccacagggattcttctggggcggtacatggatctgcgcagcacaggatacagataatgcaagtcttgtaaaagacattatgttaaagatgacaaccgatgatgacgtcatgaaagacattgttttagatgatgatgatttcgtaaacaacaataccgttatgaacggactggcagacggatcgattaaggcaaaagacggaaaagaatatagcagcaagatccttggaggacagaacccactgtctatgtactgcgcaggtgttgagacactggatctgagcaacatttccgcatatgaccagggctgcaacgaagagttccagaaagcaatgaagaattactttgaaggaaaggcaaccaaggacgaagcattagagttattctacaaaggtgttaccgagaaatatccagagcttacttactaatttttgttacacataaggtctgaagccggagtcacctctcccatattatggctccggcgggacgaccgccaataccgcggaggtagaaatatgaataagagtaaaggaaaggtcgttcgttacaacaaatggggctacatttttctgatcccgtttattgttgtatatgtcgtttttcagctgataccattgatcagcacaatttataacagttttttcgaaaattatatgtccggtctcaaccaggttggaccgacatttgtaggtttagataattacagagagttattcaaaagtggagacgtgtggatttattttaaaaatacaatgatcctctggattatgtgttttattccgcagatctttttttcactcctgctgggcgcatggttctccgatgtacgcctgcgattgaaaggatcacgtttttttaagaccgtgatctacctgccaaatctgattatggcatctgcattttccatgttgttttttacactgttttcagatgcaggtccgattaactctcttttgatgcagattggatttatctcagaaccatataaatttttatcccataccggaagtgccagaggtctgattgcactgatgaactgtctgatgtggttcggaaatacaaccattcttctgatggccggaatgatggggattgatacttctttatttgaagcggcagaagtggatggagcaacttctacacaggtattttttaagattacgctgcctctgcttcgcccgattctgatttatgtagtgattacttccctgatcggtggattacagctttttgatgtgccgcagattctgacaaacggaaccggaaatccgatgcgttctaccatgacactgatcatgtatctgaacaagcatctgtacagcaagaactatggtatggcaggagctctttccgtggtactgtttatcattacaggtcttttgagtctgcttgtatttaaagtatccggaaacgataagagaaaggggtgattgtgatggcaaaaagtaagaaagatgtggaaggcggacttggtattcatgccagacgtgccatcgcgtatattgttttagttataatttcgtttttctgcctgttctggttttatatcatgtttatcaatgcaacgcgttccaaaggtgagctgaaagcagggtttacggcattgccgagcgatcatttgctgacaaactggaacaatctggtacatggaacactgccgatctggtcgggcatgtttaacagtctgatcattgcagcagcaaccgcagttttgtgtgtatatttttctaccatgactgcatatgccattcatgcatacgattttaaattaaagaaatttatttatccgtttattctgatgattatgatgattccgacacaggttacggcactcggatttatcaagctgattacaggcatgggactgatggattcctttattccactgattgttccagccattgcatctccggttacgttcttttacatgaaacagtacatggagagtgcgcttccgctttcgctgatagaagctgcacgtattgatggttccggagagtttcgtacgttcaacagcatcgttctgccgttgatgaagccggcgatcgccgtacaggcaattttcagtttcgtcagcagctggaacaattactttacaccggcacttgtgctgcatgatgacaagaaaaagacacttccgattctgatcgcgcagctgcgtggtgcagactggctgaagtttgatatggggcaggtatatgtcatgattacattctcgatactgccggttatcgttgtgtatctgattctttccaagcatattgtacagggggttgctctgggaagcgtaaaaggataatagaaaaagaaaggggtttttacagtgaaaaacaaaacattatggaaacaggtgggagcggcagcaattgccgctgccatggtaatgagtaccgtaccggcgacgccggtacaggcggcaggcggtaaaacgcttgccgtttcttctcaaaagcagctgaatcaggcattaaaaaccgtaaaagggaaaaatgcggtcattaccgtaaaagcaggggaaaatgtaaagattacgattccaaagggaatttataaagtgaccattcgggtggtcggaaaaaaggcagccgttgtaaataatggtaccgtcaaagaaattgttgtaaacagtaagggaacggttgcgatcaaaaacaatggtaccataaagaaagtgacggtacagaatgcaaaaagtgtttccttttccggaaaccataaaaaggcagtgccggttgttgtaaatgccgaagacgtttcgatgattctggcagcaccggcgaaaataaccgcaaagaaagatgtgaacattgtgctcaaaaaaggtgcggaaaaatcatccataacgtgtacaaaaaatgtacaggcacaggtggataatcagacaaagaaagcaatatctgtaaaaattgcggatggaacaacgctgaaagtggaatccggtgaatcctgcaccataactccgaagggaaagaaagaagacacttccggagaagacaagacggatggaaaagaccagaaaacagacgatacctcggacggaaatgcttcttccggcagttcttcttcgggcaattcttctggtggaacaacagttgagacaccttcaaagctgaccgaagcggatctcttaaaacagggctatcaactgaagtggcaggacaactttgacggaaattttttaaaccgtgcagactggaatgtggaactgcatgaaaaaggctgggtcaacagtgagtggcaggaatatgtggattctgacaaaaatattcaggtcaaagacggaaaactgctgatcaagccggtggaaacggtgaatgcagacggaaccagaagctacacgtccggtcgtattaatacacagggaaaacatgattttaagtatggatattttgagtgccgtgcaaaagttccgaccggaaaaggttatctgccggcattctggatgatgccgacggacgaaaatctgtatggacagtggccaaaatgcggtgagatcgacatcatggaagtgatggggcaggaaacaaataaagcatatggtaccattcattacggagaaccgcatgatcagagtcagggaacctgtacggtagatgcaaaaaataattttgcagatcagtatcatacatatgcctgtgactgggagccaggaaagattacctggtatattgatggtgtgaaatttcatgaagagtccgactggttttctgcaaagagcgggcagggagaagtggcttatccggcaccgtttgatcagccgttttatatgattttgaatctggcggtcggtggcagctgggtagggtatccggatgattcgaccacctatgccgatcagcagtttgcagtggattatgtgaaagtatatcagaaagacagttatgacgaaaatgtggaaaaaccggtaaagaatgttattttaagagagccggatacaacgggaaattatattaacaacggtgatttctccatagcagagaatttaagtgatgacaaaaactggaaatttcttaccactttagatggtgatggaaaagcagaaattaagaatcatgagatggttatttctacagtaaatatgggaaccgcagattacagcattcagctggtacagccggatgtgccgttacaaaaaggcggaacatataaagtaacctttgatgcttatgcggatgaggcgcgtacaatgattgcagatatttccggaccggatcataattatacgaggtattggaaggatacaaaagtggaacttggaacacagaaaacgacatatacttatgtgtttcagatgacaggttccgatgatgccaacggacgtctggaatttaatctgggaaatgctgcttccacagcagcagtgcacctttccaatgtgcgcattgaaaagaccggatatgaagaaatcaaagaagacaccacaaagaaagtgcttgcagacggaaattatgtctacaacggttccttccaggaagggaagaaccgtctgggttactgggacatcacgaaaccggaaaatgcaaccacagaggtaaccggtctggaagatggacgccgtctgaaagtggtaagcccaaaaggaactgtggtaacagcaggacagcaggggcttgctctgagtgaggatacagaatatgtgctcagtttttcggctcaggcaaacgaagcagaaactatgacagtacatgttgccggacaggaatttcaggcagaacttaccaatgaaaagaaaaattaccgtttttcctttcagacggcagcggatctgacagataagaatatttcctttgatctcgggctggggacaaccgtatatctcgacgatgtgcggattgatgaggacagtctgatcaaaaacggaagttttaatgcaggtatggcaggttttgaagtctattgctatacaccatccaatgtaacgtatgttgttgactccttaaacgaagacaatgcggcagatttcacaattaacgataccggagaagctgactggcatatccagttaaagcagacaggggtaaaactcgaacagggacaatggtatcgactctccctgaaaatgaaatcttctatcgaccgtaaagtgtcttatgcgttgcagagagatggaagcacccataaggatgcagatggaaatgaggactggactccatactgccaggaaaccgtagatctgaccggcgaatatcagacgatcacgaaagagtttcagatgaaagaggatacagatctggaaacgatctttaatattgccatgggtgcagtcggtggaaaacagatcacacagcagcacagaatctgtatggatgacattgtgctggaaaagatagaggcaccggagatcaagccggaggaaaccggaaagaatctgctgaccaatggagatttttcggatgaaacgagtagatggggcattaatacaaatgatggtcagacggcaacaacagtagttactcatggcggtattgtgtttcatgtgataaatccgggcgtatatgactgggatgttcagcttaatcagcatggatttacacttgaaaaaggatgtaaatatcgtgtaaaattcaaagtcacttcgacgaaagcacgaaccataaaactcggcttaatggataacaattgccagaagtggtatggcggagaagatatttctctgggggaagcagaggaaaaggaagttagttgtgaatttacgatgcagcaggacacagataatgattcaaaaatgtttatttccatgggaaaaatcagtggtgaaaatacaccagcttcagacattacactgacgaatttctctcttgagaagatcacagagtagtaccagaaagatagtttaaaaagaaaacagaaaagacaccatgacagaatccatttttacgacagggggcgtgtcatggcgtttttctgcatattgggggaagaaaagggggggaagaggagtaataaaaggaggcatttgaatgagaaagaagagttggaaacaggtagcggcaattgtcatatgtgcggcattattaagtggatgtacgggagaaaacggacagaaaaaaaataccgggcgtaaggaaggacaggttgtaaatatttattgctggaatgatgagtttaaggaaatttatgacaaatatgcatcagatcttgctaaaaaacacgatgttgaagtgaactttgtcataatttccagtgataataatgcttatcagatcaatctggatgaagcattaaaagagcagaatacatgtattgatgatgacaaagtggatttgtttttaattgaggcagattacgcatcaaaatatgtaaagtcagataattccattgatgtaaaaaaaacagtgggactgaccgatgaggatctgaagcagcaatatgattatacaaagaaaattgtatcggaaaatggaatacaaaagggagtgacctggcaggcaacgccggggttgtttgcgtatcgcaggtccattgcaaaaaaggtattgggtacagacgatccggatcaggtacaaaagcaactgaaggattgggataagtttgatcaggttgcacagaagatgaatgccgccggatataaaatgttatcgggatatgatgattcctatcgggcattttccaacaatgtctcacatccctgggtggtcggtaacaagattgttatagatgaaaatatcaagaagtggattcgtcagacgaaggaatatgctcaaaaagattataacaatcataccacactgtggagtccgcagtggacgcaggatcagggaccggatgggaatgtttttggctttttctattcgacctggggcattaattttactctgatgggaaatgcattggcagacagtagtaaacccgcagaaaaaggaaatggaatttacggagattatgccgtgtgtgaaggtccacaggcatattattggggcggtacatggatgtgtgcggcgcagggaaccgataatattccttttatcagggatttgatgaagcgtctgacgtgtgatatcaaaaccatgaagcagattacattggatacgcaggactataccaataatgagaaagcaatggatgagattgcaaaaagtaactatcagtcggatttccttggtggacaaaatcatattgcactttttgcagaggctgcaaagaaaattgatatgagtaatatatcagattatgataaggactgcaatgagcagattcaacagtgtctgcatccgtattttgaaggtaaaatttcacttgcgcagggaatggacgatttttataaaaagatggagcaattgcatccggaattatcccattaatttaggcagaaagagaggaaatacctatgaagtggttgaatcagatcagtattaaagtaaaggttatgctgccaatttgtattttgggaattgttattcttttggcaagtatttcaagtcttgtaaattcgaaaaggctgttgcaggcgggggttgtaatttcgcaggattgttcgaagagtattgaactattgatggatatgtcatccgagctggaatccatggggaaaaatatgtatggacactgtgatgcggaaaattctatttccaaagaaagctttgcaacaaccatccatgaaaagctggaatctatggatagttattttaaacagtataaaaaacagaaaaaaacagcgcgggaaaaagaatatttcggggcattacaaaatcgctttaaaaagtataaagaaggaatggaacaggtccttaccgcaagttcaaaaggcgatgcggatggtgcaacggaggcaatcaatgtgatacagaaaccttcggaagattatcttgcaaagaaaatcagcagtctgattgctatgcggaaacaggcaatgaatcattcattacaagtacagcaggcagaatatgaattttcaaggaattctgctattgtattcgttgcagtttcaatgcttatgattttgttttctctttggatttgtgtgaaagggattgtaggaccgatgcactatatcagtcacacattgcagaaaatggtggcagatattgaaaaaaatcagggagatctttctgtaagattaaagatttcaggaaaagatgagattggtaaagttggaaggaatgtaaatgcatttattgatacgcttcaaaatgttatgggacggattacagacagttctttgcgtatgaaccagattatccgggaggtggatgacaaggtacgtagttcaaacgaaaattcggatgatatttccactgccatggaagaattatcggcatccatgatttccgttgcagatatggtttccgggattacaaaaaatatgaaagaagtggaagatcgtacgaaagaactttcggaaaaatcggatggtcttttatcctattcagatacgatggatcagaacgcggataaactcaaaaatgatgcaattttaaataaaaaaaatacgggagaaattgtcactgatattatcggaaaactgcagacaacaattcaggaaagtaaaaaagtagaaaaagtcagtgaacttactaatgatattttaaatattgcagatcagaccaatctgcttgcattaaatgcatccattgaggcagcacgtgcaggggaagcaggacgtggttttgcagtagttgcctctgaaattggtaaattatcggaatccagcagggacgcagcggttaatatccagtccatcaatagtaccgtgattggaaccgtgcaggaattgataaaaaatgctaacgcgctggtaacttatatggaacagaatatacttccggattatgacaattttgtgtgcgctggggcacagtataatgatgatgcagtctatattaatgaagtggttgagaagtttcatcagatggcggcagatttaaaacagcgcaccgagtcagtaatggaatatatttcacagattcagagggcggtagaagaaggctctgaaggtattaatcttgctgcaaaaaatacagccacgctttccgaagaaatttcacacatttccagccaaatcatgcataataaaaaaatagctgatgtactcagtgaagaagcagaacactttatttaataaaggacacagatggagaaggtatgaaacgaaaaattgcaattattgcagacggatggcgcagacatattacatatgtctggatccggggatgcaggaattacatcaaagaacatgagctggatatagaaatttcggtatttcacagtttcggaaatttcagcagggatgaaaaattcaatgcaggagaatacaatatcatccatctgccggatttgtcacagtttgatggtattattctggaagttacgaatatgctgaatcagaaaaagaggcagcagatcatacggattattcaggagtccggggtaccggcagtatcgctgcttgaaaaaattccgggattgtatcatgcaggactggacaattacgcaacaatggaacagatggtggagcatctgatagtggctcattcctgcaaaacattaaactatgtgggaggaccggcagacagccaggaaaatcttttgcgttggcaggcttatgaagatgtcctgcaaagatatggaattccgcttgaaaatgacagaatctggaatgaaagctatgaagtggagagcggtgtccgtgcattcatacattttcaggaaaaacatctgctgccggatgcctttgtctgcgcaaatgagaatattgcggtggggctctgccatcaggcacagcaggaaggatttaaaattccggctgatttttgtgtgacaggatttgataattttgataaagcatcttattacagaccgcggattacgacggtgtcatacgagagagaagtcattgctgaggcagccatggatcttttggtacagatctgggggcagaatacaacagctgactgtaaaacggttcctgtacaaatgttgtttcaggatagttgtggctgtaaaccagaacaggtaagaagcaggagtgaatatattgaagaccggatttttcaggaagtgagggaaattgatcttcacaatgagattatggaattaaagcacaatcttatcgagtgtgaagattataagcagatggcacagtattttacaaaatgtgtctgtggtctgcgttgtaaaggcgtgcgtatctggatgaatcaggatctggtggaggaatcattgagcgattccatgggtgaggcttcttatattacagatggatatccggataccatgcacgtgatctgtgaaaagggaatggagcaggaatattcattgtatgtgtatgcaccactgcatttccgggagcgggaagtagggtatgttgttctggcagactgcgattatatgcttgaaaatcagttcttgtttgaaacaatgaatacgtatctggaatccctggaatatctgtatcgcaaactcaggcttcgaaaagcaaacgaaaaattatcccggttgtatgtgctggattctcttacagggttgtataaccgtatggcataccaggagtttgcagagcctttgtatgaaaaatgcagattgcaaaaaaaaccggtgacggttatgttcattgacgcggatcatctgaaatatatcaatgatacgtttgggcatgatatggggaatctggaaattcgtgggatagcagatgggattcgtaaagtatttccgccggaagccgtttccatgcggtacggtggagatgagtttgttgtactgcttccgggatgtgaaaaagcgcaggctgaaagtttaaaggcagcgtttttaaaagcattggatgaaatatcaaaaagtcttcatgctgaatttgatgtggaagcgagtatcggatatgaggtagttctctgcggggaaaaaagtctcaatgaatgtatcaataatgcggatgaaaaaatgtatcagtttaaaaaagcgcggaaagcacagcgcgaataagtgctgtttctgggaaccggatgtccggttcccattttttctgaaatgattgcaaaagtacggaaaataccgtaagatataggaatgaagaaggagaacggcatgtattatttgatgaataaaaatgagaaaattgcaaagacggcatttgaaggggggctgcatgggcggcatctgagcacaacatccccggagtatggcacggatggttcatttgccaagtgttggatcagacttccctatgcagtggaaccggacgaatttacctacggtggtacttattaccgggagcatggaccgcggatcggtgacaactgggtaaatatagcggtggcatgctaaaagtagttttcagaaagagagaatagaacatgaagaagcgaatcatttccgtgctgcttgcaacagtgtttgcgctgtctgtgattggatgcggaacgaaagatacaaaggaacaggatgcctatcggcagtatggaattacctgcatggagagcggaaagtatgaagatgcggtcaaggcatttcagaatgcgcttggagagtcgatcggacatatcggggagaaagaactggatatctgtttttacaaggcaaaagcacaggcactggacggaaagacaaaagatgcacttgcaacgtataatgccattatcaaatataataaagatgcacgcgcatactatctgcgtggagatctttatatggatatgggagaagaaaaaaagggcagggcagattttgagagtgctgtgcagcaaggcaaaaaaaattatgaaatctacattggaatctatgagtctttaagccggcacgagaaaaaggatgagggacagaaatatctgtctgctgcgatggagatcaaaggggataaaccggaagacgaactgtataaaggaagaatcagttatctgctcggtgaaaacaaagatgccatcagttatctggaaaaagcaaaagaacataagcagatgctggcatcgtattatctgggacttgcatatgatgccaatggagattcggacaaggcaaagaaatgtatcgcggagtatataaagagtggagtagctacatcctatgatttgtatgaacttggcatgcaggagatgcaggatggaaattataaaaatgcattgacgtattttaattccggtctggaattggagaaagtgccgaataagcagaatctgatgaaaagtgccattgcggcatatgagtacagtggcgactttgattccgcgaaaaagatgatgaaggaatatttaaaggcttatccggatgatgaggaagcaaaacacgaaaatacatttttggagactagataatgggtgaaccaattgttttagaagattttaaagagagagttattctggtgggtgtaagtgagcaggatggagacgatgcagaggattcgctcgctgagcttgccgaactggtaaagactgcgggggcatcggttgccggtacgctgatccagaaacgggagctgatccatccgggaacctatgtgggaaccggaaaagtagcagagattgcagaacttttagagcacacgggggcaacgggaattgtctgtgatgatgaattgtcccctgcgcagttaaaaaatctggagacgatgttaaataccaaggtgatggaccggacgcttatcatactggatatttttgcagcccgtgcaacaaccagtgagggaaaaattcaggtggaacttgctcagctgaagtaccgcctgagcagattaactggacttggcagatccatgtcccgtctgggtggtggaatcggtacccgtggaccgggagaaaaaaagcttgagattgaccgccgtctgatcaatgaccggattgcacagctcaaccgggaattaaaagaagtggtcaaacaccgcgaaattgccagagcaaaaagagagcgcaatgcagttccggttgtggcaattgtcggatatacaaatgccggaaaatccaccctcctgaatcatctgacggacgcagaggttttagaggaggataaactgtttgcaacgctggacccgacgacacggatgctggagctggaaggacaccagcaggtgctgctgacggatacggtaggttttatacggaaattgccgcatcatctgattgaggcatttaaaagtacattggaagaagccaaatatgcggactatattattcatgtagtggatgcttccaatccgcagcgcgacaagcagatgtatatcgtctatgagacactcgatcatcttggcgttaaaaataaaaaaattctgacgctttttaataagatcgatatcagaaccgatgatgacccactgcaggattttcgtgcggatcatgttcttcagatttccgcaacggaaaatgccggactggatgcagtaaaagatgtgctgcaggaaatgttaagagaagataaaatttatattgaacgcgtgattccctatgcgcaggcaggtgtattgcagcttgtgcgaaataagggagaacttgtctcagaagagtatgtgccggaaggaatttccattcgggcatatgtccctatggaggtatacggaaaactgtaatcgctgtgtgtgaaattttataatcctttcttttggctatggttttaatggaaataaatgaaaaaataagtaaacaacaggaaatacaagtcggaacaggtaactttttgggaaattaatgggaataggaaattgtggaatatggatggatttcctaaaatataggcatctaatgataatatgattttacaggaggacagtcaggatgtcagatgttgttgaaaaacagccgttaaccgaagattacctgaagaagatggatgcctactggcgcgcagccaattaccttggtgccgcacagttatatctgctggataatccacttcttcgagagccgcttaccagagatcaggtaaagaaaaagattgttggtcactggggaaccgtaccgggacagaactttgtctatgtacatttaaaccgtgtgatcaaaaagtatgatcaggatatgattttaatttccggcccgggacacggcggaaacttctttgttgccaatacttatctggaaggtacctacagcgaggtatatccaaatatcggagaagatatggatggactgaagaaactgtgtaagcagttctctttcccgggaggaatctccagccatgtagctccggaaactccgggttccatcaacgaaggtggtgagctgggatattccctggcacattcgtttggtgcggtatttgataacccggatctgattgctgcctgtatcgtgggagacggtgagtccgagaccggacctcttgcaacttcatggcagtgtaataagttcttaaatccggagagcgatggagcggttcttccaatccttcatatgaatggatataagatcagtaatccaaccattcttgcacgtatttctcatgaagaacttgagcatttctttgatggatgcggatggaaaccatattttgtagagggcgatgatccaatgaccatgcaccgcaagatggcagagacacttgataccgttatggacgaaatcaaggcgatccagaagaatgcaagagaaaaccacgataccacaagaccaaagtggccaatgattgtacttcgtactccaaagggatggacaggaccaaaggttgtagacggaaagcagatcgagggatctttccgtgcgcatcaggttccgatcatgatggacaaaccggagcatctggaaatgttaaaagagtggttactcagctaccatccggaagaattgtttgatgagaatggaaaactgattccggaactgaaagcacttgcaccgaccggagaccgcagaatcggttctaacccacatgcaaacggtggtaagctcttacgtgacttaagacttccagatttccgtgattatgcacttgatgttccggcgccgggaagcgttgaggcacaggatatggtagaacttggcggatttgtccgtgatatcttcaaactgaatgaggattccaagaacttccgtattttcggaccggacgagacaatgtcaaaccgtctgatgaaagtctttgaggagacaaaccgtgactggaacaatgaaaaactggattccgatgaattccttgctacagatggccgtgttatggattctatgttaagtgagcatatgtgtgagggatggttagagggatatcttctgacaggacgtcatggattctttgcaagttatgaagcatttatccgtgtggtagattctatgtgtgcacagcatgcaaagtggttaaaggtatgtaatcagcttccgtggagacagtccattgcttccctgaacctgattcttacatccaatgtatggcagcaggatcacaatggatttacccatcaggacccgggatttttagatcatattgcaaataagaaggcagatgtggtacgtctttatctgccaccggataccaattgtctgctgtcctgctttgatcactgcatcagaagccgcgattatgtgaatgtacttgttacatccaagcatccgagacagcagtggctgaccatggaacaggcagtaaagcattgtacacagggtatcggcatctgggagtgggcaagtaacgaccagggacaggagcctgatgtggttatggcatgctgtggagatactccgacactggagacattagcagcagttacgattttaagaaaggcaatgccggagattaagattcgcgtgatcaatgttgtcgatctgatgaaacttgagccaagcaccaagcatccgcatggtctgacagatgcagagtacgatgcactgttcaccaaagataagccaatcatctttgcattccatgggtatcatacactgatccacgagctgacctatcgtcgtaccaacagaaatattcatgtatacggatatcaggaggaaggaaccatcacaacaccattcgatatgcgtgtacagaatgagattgaccgtttccatctggtaaagagcgtaattgagcatcttccacagttaggaaatcgtggcgcttatctgacacagaaaatgaatgacaagcttgtagaacacaagcagtacattcatgagtatggtgttgatatgccggagatccgtgactggaaatgggatttataaaataaaatatcaacaggattctttgcggaactgtgccggagtcatccggtgccgttccgtaaatattttgtagaaatatcctttgtttttgtagccgacttcggcagcaatcgcatcgattgtcagtctggtgtgcagcaacagttcttcggctttctgcagacgcagatgctgcagatattccgtataagtcattccggtccggtttttcagtaaccggttgaaataatcttcctgaaaatggaattcttcacagagcattcgtatggaaatgtttttcatatgctgcttcatataatcagaaatttcttcatataaaatccagttcattttctgtcgcagtttttttgacagcgaaaattcatattgtgtatttaaaatacgaaaaatgcgcaggagaagtccccgacagatgatcggagaagcctcatcatgacgctgtaattccaaaagaagtgatgtcatggtttcatccatctgtgagactgcctcctctgcctgagggagaaaatgcagatattgctggagcgatttctgttccatcagtgccatcttcaggaacgagctgatacgctctgttgtaatctgccgtttcataatgtcctgaaacatcacattggtaatgccaagaaacagaagtgtggcagaagttccttccatgatttcctgatgcagacagtttttgtcgatcaggcagacttcaccccggtgaaaagtaaattcattgcccagaattttctgccggtattctccgtcaatgatataaaacaattccagatattcgtgtgagtgcatctgcgtgcgcatgccgggtgtaaactctttttcataaaggaacgagggctgggagggcagaatcgttgcagaaagcatatgtccgtcatgaatatcccacagcagggaaaacagatgttcattttccggaagcggataggttttgacaacgctttcatgagccgaatattccggatgcagaatctgaaaccggctgaagttatccgggatctgtgtatttgcactctgataaatcaaatgttttgtaaaattcttcaaatccatggaacgtctcctgtaaaaaattactccaccatggaggtggagtaattgtaagtgtatgtttttgcctgttatttatttcatggcatttttcttggcgatggaagcacgcttgcgcatcgtaggatccagaattctcttgcggatacgcaggctttccggagttacctcaagaagctcgtcggtatcaatgaagtcaagagcctgctctaagcttaatttgcgaggcggaaccagagtcagtgcctcatctgcagaagaggaacgtgtattggtcagatgctttttcttgcagacatttaactcaatatcttcggctttggaactctgcccgatgatcataccggaatatactttttcgccaggtccgataaagagcgtaccacgctcctgtgcggagaacagaccgtaagttacggattcaccggtctcaaatgcaatcagggaaccggtagaacggtaagcgatctcaccgcggaatggctcatatccgtcaaacatggtattgatgataccgtttcctttggtgtcggtcatgaactccccacgatatccgatcagaccacgggaaggaatcttgaactctaagcgggtataaccgccggcaatggaacccatatttaaaagttcacccttccgttgctgcagtttggagataacggcgccggtaaattcatccggtacatccacgtaagcaagttccattggctcaagttttttgccattctcatcgtagtgatagagaacctcggctttgctgactgcaaattcatatccttcacggcgcatattctcgatcaggacggacagatgcagctcaccacggccggatacttttaagctgtccgggctgtcggtttcttcgacacggagagaaacatcggtatttaactcacggaacagtctgtcgcggatatgacgggaagtgacatattttccttcctgaccggcgagaggactgtcgtttacgatgaaattcatggagatagtcggctcagaaatcttctggaacggaatagctaccggattttccggagaacagatggtatctccaatgtgaatgtccgcaataccggagatggctacgatggaaccgatctttgcttcactgacatctactttatttaaaccatcgaactcatacagtttgctgatgcggactttctcaagtttgtccggatcgtgatggttgacaacgactgcttcctggttgactttcagggaaccgttgtcgactttaccgataccgatacggccaacgtattcgttgtaatcgatggtactgattaaaacctgtgtgttggcatccggatctccggtcggggccgggatatagtttacgatcgtctcgaaaagaggagtcatgtccttcttttcatcgtcgagattatacatagcgtatccgtctcttgcggaagcgtagatgaacgggcagtcaagctgctcatcggaagcatccagatccatgaaaagctctaacacctcatcaatcacttctgcagggcgcgcttccggacggtcgatcttgttgatgcagacaataaccgggagatttaaagcaagtgctttcatcagtacgaatttggtctgcggcatggttccctcgaatgcgtctacgacgaggactacaccatttaccatcttaagaacacgctctacctcaccaccgaaatcggcatggccaggcgtatcgataatgttgatttttgtatccttataaaatacagcggtatttttggacaggatagtgataccacgctcacgctcgatatcgttggaatccatgacacgttcctgtacttcctgattggcacggaacacaccgctttgttttaacagctcatcgaccaatgtggttttaccatgatcgacatgggcgatgattgcgatattacgaatgtcgtctcttgttgttaccataaatttaaccttctttttaatattgtttaactttacataaataacctatcctattttatcataaaaagctgatttcgcaagcttttttcagcgtacaccggcgatttaagcgttttagatagttttcgccggccttatcgacaaggtttgatgatttctaccaaccattaaatggtaaaacagaagcctatcaaaaatttccacaaaaggaaggagtattcatggcagataaaatgtgtgaaaacaatcaggtcactattatgggagaaattgtatcggacttttcgtatagtcacgaggtatatggggaaggattttatatggtggaagtatctgtccaccgcctgtccagtttcgtcgattatattccggtgatggtatcggagcgtctggtcaatgtgcaggagagtgcggagggaaaatgcgtctatattacaggacagttccgttcattcaaccggcatgaggagcataaaaaccgtctggtgttatcggtttttgcgagggagtttgaactggttgagcagtttgaggaagaaaatgcagccaaccagatttttctggatggatttatctgtaaggaatcggtataccgaaaaacacctctgggaagggagatcgcggatcttctggtcgcagtcaaccggtcatatggcaaatcggactatattccctgcatctgctggggcagaaatgcaagatttgcatccggattcgaggtcggatcacatgtgcagatctggggaagaatccagagccgcgagtatgtaaagaaagtcagtgagacacaggtggagcagagggttgcttacgaggtatccgtcagcaagattgaattcctggagtagacttgattatttgacgcttttgtgttatcttacataggatttcatttggttaagagatatcatggaggctgaaatggacagaggagtgattcaggtttattatggagagggacatggtaaatcgaccgcggcaatcgggaatgcaattcgtattgccagcgagggaaaaagcgtcattatcattcagttcttgaagggaaaaaatgaaaacgaactgacatttttaagccggctggagccggaaataaaaatattccgttttgcaaaatcggatgagtgttttgaggcactttccgaggaggcaaaacaggaagaaagtatgaatctgcgcaatggattcaattacggaaagaaagtcgttacgacaggtgcctgtgatatgctaatcttagatgaggtacttggaattgtggacgaaaaggtgataagccctgaagaaatctgtgagctgtttgccgcaaagccggaagaaatgactctggtctgcacaggacgcgttctggatgaaaaaatccgtgaggcagcagacgaggtttataatatcgcaccggagaaatagattgacagactatgccggtggtggtagaatgaaagaaatacatgggatagaggtcgcgtaattcatgagtagcctgttggatgtggcagacacagtcgaatgcaggtaaaaggggaaagcgccgaaagaaccggatgactgcagtctggtttttgggcatgcggtgaataatcgtatgactgtcagaagcgtatgagcgtggatggagagctatcagatctaaaaaaggttagattgaccagctcgttttgagctggtttttttatttagaaaggagaataaaacagtggcaatttttaagggagccggagtcgcaatcgtgacaccaatgaagaacaatgaggaagttaattatgataaacttgaggaactgatcaaccagcagattgacggtggtacagatgccatcgtaattgcaggtacgacaggagaaagcgcaacacttacgatggaagaacaccgtgatgtgatcaaggcagccatcgagtttacaaaacatcgtgttccggttgtggcaggtaccggttcaaactgcacacgtacagccatccagctttcacaggaggcagaagaggcaggagcagacggacttctgatcgttacaccatattataacaaggcaacacaggcaggcctgatcagccattattcacagatcgcagacagcaccaagtgtccgatcattatgtataatgtgccgggacgtaccggatgtaatcttcttccggagacggttgccgagctggtccgcaccaagagtaatctcgtaggattaaaggaagcaaccggaaatctggcacaggcttccaagacgatggcacttaccgacggaaaactggatctttattccggtgaagacggtcttgttgtaccgcttatgtcaatcggtgcagtcggtgtgatttcggtatggagcaatgtggcaccgggcaaagtacacgcaatgtgtgaaagcttcttcaagggtgatattaagacagcaagaaaactgcagctggaggcgcttccactggtagatgcactgttttccgaagtaaatccgattccggttaagaaggcattaaacctgatgggtatggaagtaggacctcttcgttccccactctgtgagatgagcgaggctaatgcaaagaaacttgcagaagtaatgaaaaattatggaattttagcatagatcagggaggcacaaaagaaaatgacaagagcgatcatgaatggctgcaacgggaagatgggacagtgtatcacaggaatctgtgcgcaggatgaggacattgagattgttgcaggaattgatacttatgatggaatcaaaaatgattatccggtatttgccagtctgaaagagtgtacggtggatgcggatgtaatcattgatttttccaatgcaaaagcagtggatgcgctgcttgcatatggtgtggaaaaacagattccgatcgtgctttgtacgacaggactttccgaacagcagcttgccgatgtggaaaaagcatacgaaaaagttgcaattttaaaatccgcaaatatgtctctcggaatcaatactctgatggaactgctcaaaaaagctgcgcaggtatttgcgccggcaggatttgatatggagattgtagagaaacatcataaccagaagctggatgcaccgagcggcacggcactggcactggctgattccatgaatgaggcactggatgaggcatatacctatacctatgacagaagccagaagcgcaagaagagggataaatacgaaattggactctcttctgttcgtggcggcaatattgtcggagagcatgaagtgattttcgccggacaggatgaggtgattgaattcaagcatacggcatactccaaggcggtatttgcaaagggcgctgtggaagcagcaaaatttttaaaaggaaagcctgcaggacattatgatatggcagatgtcattgcggcaaaataaacgggaagagaggcactgataatcagtgccttttttgcgcaaaatgtttgacagtgcagctggttcatatttataatggaaagaagaaaactgacgataagaaagaggtagaaaatgaaaaataaaaccagaaggcttgcagcatttttgctttctgcagcagttgtcataactgctgttccgggaatgcaggaacgggtttatgcccagaaaaccggcggatacacagagtcacccaaaagtgaaaatgttccggtggtacaagaaacaaaatccaggctgaaaaaggcagaagcagtgccgtccgcctatatgaacaagttgtcggaacttacgatccgctatcctggcgtgcgtgatcagggaaaatatgatacgtgctgggcattttccgcaatcggacttgcggagtttgatctgattgcagacaatcagacggcagacaaaagtattgatctgagtgaattgcagcttgcctattttacttataataatgtagaagacccgctgggtggaacatttggcgactctttaaatattatgaaccataaaaattatctgactatgggcggaaatctggatttcgcgagccggacgcttctgcagtgggaaggggtgacggacgagaaccgtgtaccgtacgctctggcaccgaccaccacgacactggcaaaaagttacgcttttgatcaggatgtggcacatctgcagaatgtatatattattaatattcacaaaaatgctacccaggtgaaatgtgagattatgcagcacggatctgccgggctgggactgtatatggacggaacggccaactatgtgggatctgcagtctatgcagaaacaggagagaatgtggcaacctattactgcccgacaagcagtgttgcatcgaaccatgcagtgaatattgtgggctgggatgataattttccggcatcttcgtttaaaaataaaccggcaggagacggagcatggctttgcaggaacagctggtcggataagacagaaaacaatatcaacagttatttctggctttcttattatgataaatccatcgaggatgctgcatggatttttgattttgagtctgcggataattatgattataattatcagtatgatggtggggcagatgtgggaaaactgcttggaatttcgacttcagcgaatattttcagggcaaaaaaggcagataatgaactggtgaaagcagtttcaatttccctttccaaagatgcgaatgttccatatacgatccgtgtatatacgaatctgacaaacctgcataatcctaagagtggcatacttgcagcaaaggtgtccggtacaacaacgtatgccggaacccataccatcaggctgaataaagcggtatccgtacctcagggaacttactatgcggttgtggtagaactgcagaaaagcggtgccggactcgatatggaatatgcagtcagtgacagcagtttaaccagccgggtatattgtgattataatcagagtttcctctatcgcggtggcagctgggaagatgtggcggatgtaagcaccagttacggtggaagaatcggaaacatctgtatcaaggcatatgcggataatgcagggacaagtatcggtgcggtagagaatataaaagcggtccgctgtgcaaaaaatgcagtgcgtatttcctggggcaaaacggcaggtgcgaaagggtatgaaatttatcaggcatccagcaagaacggaacttataaaaagattgcagctacaacgtccacaaagtacaaaattaagacaacctcaaagaagtcggtatattataaagtacgcgcttataagacaacgcagggcattcggatctgtgggaatttttcgggatctgttgctgtgaaacgttaaaagaaaggaaaaagaatgaccattttaatcaaagggggacatgtcatcaatccggcaacacagatggatgaagtggcagatgtcctgatcgaagatcagaagataaaaaagattggaaaagaacttccggaaaaagaagccgaacgtgtgatcaatgcggacggatgttatgtgatgccgggatttattgatatgcatgtacatttccgcgatccgggatttgaacagaaagaggatatttataccgggatgcaggccgctgcgcatggtggatatacgacagtgctgaccatgccgaatacaaagccggtagcagacaatccggatattatcaattatgtgcacaacaaagcaaaatccgggagctgtattcatgtcctgcaggttggtgcggtgacaaagggacagcagggaaaagagcttgcggatattgaaggaatggttaaggcaggaagtccggcaatcagcgaggacggaaaatctgtcatggatgccgctttgtatcgggacggtatgcttgaggcagcgcgtctgggcattccggtacttgcccattgcgaagatatccatatggtacgcggaggtgtcatgaatgccgatgcaaaagcaaaagaactgggacttccgggaattaccaattccgtggaggatgtgattgttgcaagagatattattctggcaaaagataccggggcacagcttcatctgtgtcattgttccacaaaggattccgtgctcatggtaaaagtggcaaaggaagaaggtgtccgggtgtcggcagaagtgtgtccgcatcactttacgctgtccacggacgatatgaaagaagcggataccaattacaagatgaatccgccactccgcacaaaggaagatgtgaaagcactgcgtgagggactgcgggatggcattatggaagtgatttccacagaccatgcgccacacacatttgaagataaaaaccgttcgatgcaggaagcaccgtttggaattgtcggactggaaaccgccgcatgtcttacacataatgaactggtactcggtggatatctgacgccgatgcagatggcagcgtgtatgagttaccatccggcacagattgtcggtattgataagggagatatccagccgggaaaagcggcagatgtcgtgatctttgatccagaggaaacctaccgcattgacaaaaacacatttgcttccaagggaagaaatacaccgtttgacgggaaagaagttacgggacgtgtaaagtgcacgatctgtgacggcgaagttgtatttaatgaattaaataagtaataaattaagaagggaaatcaatcacatgatcaacaaattagtagaaaaaattaaaaagaccaacgcacctatcgttgtgggactcgatccgatgctttcttatgtgccggagcacatacaaaaagcagcgttcgctcagttcggtgagacgttagagggagcagcagaagccatctggcagtacaataaagctattgtcgatgcaacatacgacctgattcctgcagtgaagccgcagatcgcgatgtatgagcagtttggtgtggccggtgtagcggcattccagaagacggtagattactgccacgagaaagatctggttgtgatcggagatgtaaagcgtggggatatcggttccacatccgcagcctatgcgaccggacatctcggaaaagtacagatcggaagcaaaacatataccggttttaatgaggattttgctacagtaaatccatatctgggaaccgatggtatcaagccgtttgtggatgtatgcaaagaagaaaagaaaggaatctttattctcgtaaagacctccaatccatccagcggagagttccaggatcgtctgatcgacggtcgtccgctgtatgaactggttggtgaaaaggtagcagagtggggaagcgaatgtatgggagattcctacagctatgttggagcagttgtcggagcaacgtatccggagcagggggaaattcttcgtaaagtgatgccgaaatcgttcattctggtaccgggttatggtgcacagggaggacagggcaaggatctggtacatttctttaatgaggatggattaggagcaattgtaaactcttcccgtggtatcatctgtgcttacaaacaggataagtataaagagcagggaatgacaccggagaacttcgcagatgcctcccgtctggcagtcaaagatatgatcgcagacatatccggagcacttgcacagagataaaaataaagtcgtgattttacaaaagggagacagttggattttatgagcgaaaaatttcaggaaaatgttacggtgctgaagcagcagtgcatcggaaaagatatctatgacatgacaatccagacgaagcatattgcaggacatgcaaaggcaggacagtttgtatcattgtacagtaatgatgccagcaaactgctgccacgtccgatcagcctgtgtgggattgatgcagaggcaggaacacttcgtctggtataccgggtaacgggagaaggaaccggaacggaagaattctcccggttaaaagcgggcgatacgatccgggtactgggaccgcttggaaacggatttaccgtggagccgggaaagaaagctttcctgatcggcggaggaatcggaattcctccgatgcttgaacttgcaaagagcatcaaggctgccggcacctgtgaatttgtcagtgtgatgggataccgggatgcacagacgtttcttctggatgaatttaaagaacagggagactgttacgtggcaacggaagatggaagtgtcggtgcaaagggaaatgtgctggatgccatcaaagaatataaattaaatgcagatgtaatatatgcgtgcggaccgacaccgatgctgcgggcgttgaaagcgtatgcagcagagcagggcatgacctgttatatttccatggaagaacggatggcatgcggaatcggtgcatgtctggcatgtgtgtgcgattccaaagaaaaagatgcacattccaatgtgaaaaacaagagaatctgtaaagaagggccggtatttctggctgaggaggtggatctgtaatgaatacaagtgtggaattatgtggtgttaccttaaaaaacccggtaatgacggcatccggaacctttggctccggagcagaatacagtgaatttacagacttaaaccggcttggtgcggtggttaccaaaggtgtggcaaatgtaccgtggccgggaaatccgactccgcgtgtggcagaagtctatggcgggatgctcaacgccgtgggattgcagaatccgggaattgatctgttctgtgagagagatattccattcctgaaaaaatatgatactaaaattattgtaaacgtatgcggacactcgacagaggaatatgtggaagtggtaaaacggctggcagaagagccggtggacatgctggaaatcaatatttcctgcccgaacgtaaaagagggtggaattgcttttggacaggatccgaacgcggtagaagcaatcacaaaggaaatgaaaaagtatgcaaaacagccggtgatcatgaaactgagtccgaatgtcacagacatcacagagatggcgcgtgcagcggaagcaggtggtgcggatgccctgtctttgattaacacgatcacgggaatgaagattgatatcaaccggagaaaatttgttcttgcaaacaagaccggtgggatgtccggtccggccattcatccggtagccgtgcgtatggtttatcagacggcacaggcagtaaagattccgatcattggaatgggaggaattatgaatgctgcagatgcgattgagatgatactggcgggtgcgacagctgtatctgtcggcaccgccaatttccggaatccggcagtgaccatggaaattgtagaaggcattgagcgctacatggaaaaatatcatgtgagcgatatcaaagaactaatcggtgccgtttcggaataaagatatggtaactgcttactgtttttgaatatattgtaccagggatttcattttggcagcaatgttttccagaatctgtgtgtttacggtctctgcatccattgtttcggatgcatgggcggtcagttcttcagaaactgcggaaattgtctgtacggaatctgaaattgcctgattagagttacgcagatctgtggtattgctggtcagttcctcgcaacacagtaaaagtaaccgttaaataacagccggatccgtatttaagaacagcatccgaaactttgcggggcggatcgcctcgcagggttggggatgctgtttctttttatgattcgcgcattgaaaacccaccggaagtatgctaaaatttaatagaaaactgcgaaataacaagggcagaatgctttttgatacaggaggaaagtatacaatggaaagttacaagagtgagttcattgagtttatggtagagagtgatgttctcaaatttggcgattttacactgaagagtggaagaaaatcgccattttttatgaatgcaggtgcatacgtgacaggttcccagttaaagaaactcggagagtattatgcaaaggcgatccacgccagttacggggatgattttgatgtgttattcggaccggcatacaagggaattccactggctgttgttaccgcaattgcattcagtgaattgtacggaaaagagatccgttactgtagtgaccgcaaggaagccaaggatcacggggcagacaaaggcggatttttaggaagcagcttaaaagataaagaccgcgtggtgatgatcgaggatgtgacgacatccggcaagtccatggaagaaactgttccaaaagtacgtggggctgcaaacgttgagatcgttggtcttatggtcagcttaaaccgcatggaagtcggacagggcggcgtaaagagcgcactcgatgaaattcatgagaaatatggttttgaaggaaaagcaattgttaccatggaagaagtggtagaacacttatataatcgggaatgtcagggcagaattgtaattgatgacacgatcaggaaagcaatcgatgcctattatgagcagtatggatgcaaataagcaaaaaggttgtaggaaagagagacgcatatgagaaaccggagaagacgtggctataagtttaccgagaaaaaacattccagacagggaatattggccacggtattagcacttgctcttctggtatggtatcttgtgttcctgaagcttgcttttcagggaggcggttcgctgtctgcttattatgggagcgcaggagtcgttgcgatgatcgcaacatttgttgttcttgtcatcgcagccaaaagtctgcgggaagaagattccttccagttgtttccgagactgggactaggactgacccttttggatatggtatgctggatcggaacctatatctggggatttttgagctaaaaactataagaaggaaacaaactatgagctttagagagatcaatcacaaaaataacgaggaatactgggaacggctggaacttgtgatggagcgcattgaggcggtcagcgaggaggaagcctccagtgtggaagaactgtaccggggatatttctttgaaatgtcggaactgtttctggttttgtataaattagcagaagcgtccctgagtggaaaactggcagaaatttccacgctggaagggaaaaagatcaatcgccgtctgtatctggatgtgcaggaagattatgcggacagttatgcaaacccggcatatgccgtcagtaagatgggctgggaatacggaccgctgctctcggcattggatgccagactgcatggaatttataccagctgtatggaaggaaatatccgttatctgtgtatttatgcggaactgtttgtggaaatttacaactgttttgaggatgcacagaatctgaatgtgcacgagatcagaaaatgcatttattcttttatgcatgattacacagaaatttttaatgcggatgcgatctgcagactgatcgatccggaatatgattatttcacccagatcgtgatggaagcggagctggatcatccggcatatctgtaccgttatggtctgtatatcggaaaagatgagacggagtccgcacattttctgcattccttgacaaagcagcagatgcaggcaatggcggatacatttaccgaaggataccggatcggatttgaaacaaccggaaaagatatttctaaaaagtcggtagtggagatccgttatccgttgggattcgagcggatggtacgtgccgccgtacacaattttaaaaagatcggattgcagccggtgctgcgtccgtactctatttccctgaacaagcagtttacttacgatcacaaagaggaccgcgggctgtggctggataaggcactcatcgagcggggactcgaagttgaccgtactgtctgggaaaaacacaaagcgattgctccaaattacggaggaccggcagtgatcgaaattttcgggacaaagccgttttcgccggagcagaaagaggagcgcgttacctataccgacaaacagagggaaatcgatgtgtatgagcgcagcgagaagagccagctgatcaatcattacattcacggggaggaacgcagttttacgattattgcttacccggttccgtccatcggagaaaaatacgaagaaatctttgcggaaacggtgcatatcaatacgcttgattatatgctttaccgcaatatgcagcagaagatcattgatgtgctggatacgtcggaccgtgtgcacatcaaaggctgtaacggaaaccgcacggatctgtatgtaaagattcatccgctttccgatcctgccaaagagaccgcatttgaaaactgtgtggcagatgtcaatattccggtcggggaagtgttcacatctccggtattgcagaaaacagaaggaaagctgcacgtcacacaggtctatctgggggaattccttttcaagaatctggaactggattttgaaaacggaagaattacagcttattcctgtacaaattttgattctgaggatgaaaaccacaagtatatagaggacaatattctgttccatcacaaaacacttccgatgggagagtttgcaatcggaacaaataccaccgcataccggatggcacggaaatatcagatcgcggataagcttccgattctgattgcggaaaagacaggtccgcattttgcggtcggagacacctgttacacgtacgatgaggacaacatgacatacaatccggatggaaaagcgatcatcgcaagggacaatgaaatttcgatccggcgcaaagaagatatttcaaaagcatattttaactgtcataccgatattacgattccgtatgatgagttaggagcgattacagtagtacgtgcagatggcacgatgacagatattataagaaacgggcggtttgtcgttccgggaacggaaccgttaaatgagccgctggatgcaatggaaccataaattttttcacatataggaggatatttaaaatggcacaagtaggaattgtaatgggcagtgattcagatatgccgatcatggcaaaggcagccgacatcttagaccagctgggcgtcagctatgagatgacgatcatttccgcacaccgcgagccggatgtattttttgaatatgcaaagagtgcggaggaaaaaggatttaaagtgattatcgcaggtgcaggtatggcagcacatctgccgggcatgtgcgcagcaatcttcccgatgccggtcatcggaatcccgatgcacaccacttctcttggcggaagagattccctgtacagtatcgtgcagatgccgaccggtattccggtagcaaccgtagcaatcaacggcggagcaaatgccggtattcttgcagcaaagattcttgcaaccagtgatgcggatttacttgcacgcctgaaagagtattctaaaaacttaaaagagcaggttgaggcaaaggatgccagattgcaggaagtgggatataagaactactaattagatttattaacatttatgattggtaaaatcgaaaaatacccgatatactataagcgacaataatagattaaaacacagatattaggaggaaaaataaatggattacaagaacgcgggcgtagatatcgaagcaggatatgagtcagtggaactgatgaagaagtttgtaaagggaaccatgcgtccggaggtattaggcggacttggcggattttccggtgctttttcgctggatgcgatcaagaatatggaagagccggttcttttatccggaaccgatggatgcggaaccaaggtaaaactggctttcctgatggacaagcatgatacgatcggtattgatgccgttgcaatgtgtgtcaacgatgtagcctgtgccggtggtgaaccgttatttttcctggattatattgcatgtggaaaaaattatccggagaaaattgcaacgatcgtaagcggtgtggcagagggttgtaagcagtccggatgtgcactgatcggtggagagactgcagagcatccgggactgatgccggaggatgagtatgatctggccggatttaccgtaggtgtggttgacaagaaggatatcattaccggagaagacgtaaaagccggggatgtgctgatcggtatggcaagttccggtgtacattccaatggattttctctcgtgcgcaagattttccgtatggacaaagaaaccttaaatacatatattgatgagcttggaacaacgcttggcgaggctcttcttgctccgacccgtatctatgtaggcgcattgaagtctatcaagaacgctggagtacgtgtgaaagcctgcagccatattaccggtggtggtttctatgagaatattccacgtatgcttccggaaggaaagcatgccgtagtggaaaagaacagctacccggttcctccaatctttacccttatggcaagagagggaaatgtagatgagcatatgatgtacaatacttacaacatgggacttggaatggttcttgcagtcgatccggcagacgtggacaagacgatggaagcaatcaaagcagccggagatactccatatgtggttggtaagatcacagacggagagaagggtgtaacattatgctaaaaatcgcagtatgtgtatccggcggcggaaccaatctgcaggccattatcgatggaattgaacaaaaaacaatcacaaatacagagattgcggtagtgatcagcaataatccgggagcatacgctttggaacgtgcaaaaaagcacggaattgaggcagtatgcatcagcccgaaggagtatgagagccgtgcggcatttaatgaagattttctgcgcagacttgatgcgtatgaggtggatctggttgtgctggcaggattccttgtcgtcattccggaacagatgattgcaaagtacagaaaccgcatcatcaatattcatccgtctttaattccgtctttctgtggaaccggatattatgggctgaaagtgcatgaaggtgcacttgcccgcggagttaaagtcacaggtgccaccgtgcattttgtggatgagggaacggataccggtccgatcattctgcagaaagcggtagaagtgcaggagggcgatacgccggagatcctgcagcgccgtgtcatggagcaggcagagtggaagattatgccacaggcgatcgacctgatcgcaaatggaaaagtgacggtgacgggcaaaaccgtacatatcagtaaataggaaatgcatcacatataggaggataatcatgaaagttcttgtaattggaagcggtggacgtgagcatgcaatcgtaacaagtgttgccagaagtccgagagttgacaaaatatattgtgcacctggaaatgcaggaattgcagctttggcagagtgtgtgccgatcggagccatggagtttgacaagctcgttgcatttgcaaaggagaaatccattgattttaccattgttggtatggatgatccgctggttggcggaatcgtggatgtctttgaggcagagggcttaaaggtattcggaccgcgcaaaaatgcagcgattctggaaggatcgaaagcattctccaaggatctgatgaaaaagtatcatattccgacggctgcttacgagaactttaccgatccggaagaagctttaaaatatcttgagacggcaaagatgccaatcgtgttaaaggcagacggtctggcactcggaaagggtgtgctgatctgtaatacactcgaagaggcaaaagaaggcgtgcgtacgatcatggaagataagaaattcggaaatgccggaaatacgatggtaatcgaagaatttatgaccggacgtgaagtatcggttctgacctatgtggacggaaagaccatccgcatcatgtcttccgcacaggatcacaaacgtgccaaggatggagatcagggactgaataccggcggtatgggaaatttctctccaagtccgttctatacaaaagaagtagatgaattctgtaagaagtatatttatcagccaactgtagatgctatggctgcggagggaagaccatttaccggagttattttcttcggactgatgctgacaggggaaggaccaaaggttcttgagtacaatgcccgttttggagatccggaggcacaggtcgttcttccacgtatgaaaaatgatatcattgatgtcatggaagcatgtgtcgatggaaaacttgacacgattgatctgcagtttgaggacaatgcagctgtctgtgttgtacttgcatctgacggatatccggtttcctatgagaaaggattcccaatcagcggacttgaaaagttcgagggcaaggatgattacttctgtttccatgcaggaactgcattcgataaggaaggacgcatcgtaacaaacggcggacgtgtccttggcattactgcaaccggaaaagatttaaaagaagcaagaaagaaagcctatgaggcaaccgaatgggtggatttcgcaaataagtatatgcgccatgatatcggaaaggcaattgacgaggcataatgaaaaaaggaatcatatttgatatggacggaacactctgggattccgctgcggaagtggcagagtcctggaatgagactgtaaaaagagccggctacgacagaaaaccgattacggtaaaggacatccagtcagtaatgggaaagacgatggatgtgatcgcacggattctgtttccggatctggaagaaggcgaacgccagaaacttctggcacagtgtggggaagaagaaaatgaatatctccggatacacggagcaactctctacccggatatccgcaggacaatggaacagttgaagaaaaaatatcatctgtatattgtaagcaactgccagtccggatatatagaggcttttctggattattacaaactgcacgatctgatagaggatactgagtgctacggaaataatgaaaaatcaaaaggagagaatatcgcgttactgtacaggcggaatgcattggatgatgcggtatatgtaggtgatattcagggagattacgatgcaagcatggatgcgggggttaaatttattcatgcggcatacgggtttggtacaatagaagacaaggttcctgaaattcacaaattctgtgaattggagaacgtggcagatcaggttctgctgtagataagaggttactatgcgggagcagaaagaacaggaaaagcaaaatgaacttctcagggtggttgcagagcaaaaccatgagagattgatagaatatgatgtaaaagaagaccgggcagtggtttatgcgatagaaaatgaccggttcgaggtcctttttgatatcgaagattatgtaaagaagaaccattatggatctgtttttattgatccggaagataaaaaggtatttcgcagagcgatgcatgcctgcctgcaaaaagaagggactgttacggtcgatgtccgttattgcgaaaaagaaaatcaaccggaatggtaccgtttttatctggtgagtattgcggaagaagatggaaaaacagaccgtatggtggggcgtttttgctgtgtgcagcaggagaaagccatcacggaacgcatgcggcgccgggcagagattgatgtactgacgaatgtgtataaccataaggcatttgaggaatactgcgcaaaagagcttgcggaatgtacaacaaatgccttatttgtcatgcttgatattgatgattttaaaatgatcaatgatacgcagggacatgcggtaggggatatggtcttaagccagaccggaagtattttaagtgaagtgaccggtgaccggggaattgtcggcaggcttgggggagatgaattcgcggtgtttgcttccggctttcagaattctgttgaaatggaagaattttgtgtctccctgcgtgaaaatttgaaaaagattatctttgatatggaatattccgtatctatcggtgctgcgaaactggatggacgaagaatcagttttccggatttttattatgaggcagaccgggcagtttacgcggcgaaaagaggcggaaaaaaccggattgttttttatgatcagatcaaagaaaatcaggagccggaaacggcagatccggtggaaccgattctcgcacaaggcaatgaaaaatccatgttaagacagctccgtacctgtatggaagcgcttggaagagagggaatcggagatgcccttatgcaggcatttgaagcgctgcgccagtattttgacgcggactgtgttgtgcttgcctatgcaaaagagggcggtatccgctatgtggaagagtgtcacagggatacggcacagatgatggcaagacttgtgaccgagaaaattgagtcaggagatgcagaaggagttattcaggaaataggacaactcggggacgtggtgattccggatatcaagtcgctgagagaaagtcatccggtgatctatgaatatctggcagaactacgtgcatggtctgcagccgggatttctttgtatacaggagatcatctgcttggaattttaatggttttaaacccacacagacacctcgaggagaccgatgttctttccatgcttggcacgacactggctgcgcggattgaacttcgcaatctgcaggagcagcaggaatatgaccgcacacatgacaaactgaccaatctctggaaccgggagggattgtccgttatggcacgtactggtgcggacaatatgttctgttcacttggcgtgattacaaccgatgtgatccatctgtcggagattaataaacagtttggctatatcagcggcaaccgcagactgatggaagttgcggatttattgaaatccctgtttcccaattaccggatttaccggtatgatgaggatgagatgctggttttgtgtatcaacattaaacggcaggaaatggagcagcaggtggaaaatctgcagaaaaggcttgccggacttggctttggcgtggcgatgggatacagctggagtgcacatccgcagacacgcagccagattgcagaggcagaggttcttatgagcaacgataagcttaagctgatgcatggcacaaccgtgatgaagcgcatggagcagagcgtgatagatgagatcaacgatctgatggagcgtggaaggtatctggtatatctgcagccgaaagtggatatccacacagggcgcacagagggcgcggaggcgctgatccggcagctggatgatgaactgggcattgtgggaccggggatgtttattccggtgctggaacattacaatttggtgcatatgattgacctgtttgttctggatgaagtatttcgttatcagaaggaacagatccgggaaggacatcgtacggtgccaatatccgtgaatttctcgaagatgacgatcatgtatccggaacttattgaaaaagtaacgcagatggttcaaaaatatgatattccggtggaactgatccatattgaggtaacggagaccgtgggagacatggatcatgttctgattgaaaatgttgcaaacagcctcaaagaactcggattcagactgtcaatggatgatttcggaagtcattattccaatcttgcggtactgatccagtatgattttgattctgcaaagattgaccggtccatggtaaccgaaattaccaataaccgcaaaagccggattctcctcgactatatgacttccatgatcaatgatctgggaattcactgtatcgtcgagggaatcgagacaaaagagcaggtagatattttaaagaaaacaaaggcagagatgatccagggattttactttggaaaacctgtgccaaaagaaaaattttatgaagcctttatcgcagagtagtggagcatatcacacaaacgtcaggctgctgctgacgcagagtgctccgtatccgctctgcggattggggtaggaaacggaaaatggaagctgtctggcacctcggatcagatatgctttcattttttcaccatatagaaagggatcattgttctgtagaatgccccactgcatgagcagtgcgcagctgccgcttacaaaaggagcagccatggaggtgccgcttcgggattcgtaaccgcccccgacagcacagctggtgatgtcgacaccgggagcgaccagatccggtttgacctgtccggtattccaggtatatcctctgccggaaaaaggggcgagcgtattggtgaaagaattgtaggcaccgacggtaatgacatttccggcggtggaaggtattgtgagagtggtttccgttgtcggcgtgagaaattgtgtggcagtcccgcggatagcggccgccggcatccacagatcaataattccttcgatgacagaccgtgcttctgcggtaaaaaaccagacacctcccgaaatatagtcccgccgcggcagcagatcgatggcaatttcctgatacagactataaggggagggaagtccgtagtacaccagaatctgtgtggtgccaaaggaaaagcgccagctgccgggctgattgggaattttaaatgaggttccgagtcccggaggagtcagctgaaaacgaatatcatcccaataatttttccagatctgaatcgaaagagaagattcataatttccaacggcaaattcaattctggcagattctaaagaagccagtcgggcgctggcatgcccgccgttgtttccctcatttccacttccgacaacaatattaatgcgtccgagatttgagacatagtccaggtaggtttccagaagggatgttccgctgtgggagccgtaagtatttccaaaactcaggttgatgacaagaggcacggtatgttcaatggcatatcttacggaaaaatcgaccgcctgcatcagttcgatcgtgtttggaaatccctttggatcgggcgagccgagtttgacggcaagaagtgaggattccggggcaactccgcggtagagtccgccggaggcacggccgtttccggcggcaataccggcgacatgggttccgtgccctgtgacatctgtgctgggtacaagttccatgcgctgctcaaaagtgtctgcctgaagtgccgcattgatctgttccggagaaaaaagtgtaccctgtgaataaccggcgggggcaaagcgtccagcagaaggatcagcgaggatggtctggtcccagagagcaaccagccgtgtggttttgtccggattgcaaaaatcgggatgcgcatagtcaataccggagtctatcacagaaatcagaatgccttttccggtcagaccatagctgctgttttcctgaatggcactcagacaggaagcctgccgggcagaaacaatctcaaagaaaagctgtcttggacgttcgatatatattacttgtggaaaggcggcaagtgatggaatgtcgtcctcggagattttcactatggcataatttccaaggagaaaggtaaaggaagaggaaggaaattcattctgtaacgtctgtggagaaccggtgtacagaacaatcaggttccagaacccgtcagagctgctcccagtggacagatcatcggaagcgtttcgttcgacgggagttgcctcaagcgaagcgcgcagagaaacatcaattttctgattgaagtccatcgtattcatattatccataaaatcgcaccgtctgatgtattttgatagatacatctatagctttttaatgaaaatttatgtacaataaaaacatattatgcttaatagaaaccacgaaaaagcaaaggagattttatgtacgctgatgaaaatgtaatcaagatcaagcatgcggttctgcgtgaagtcgcaaaactggcatttgaagggactcttgatgctcagagagaccacatcgcggttcgtctgattccgggcccgacaccacagttccgttgttgtatctacaaagaaagagaaattatccgccagcgtgtccgtcttgcagagggcaaagccccgggaccggaggataatggaaacgtgattcaggtaatcagtgcagcctgtgaggactgcccgatttccagttataccgttacagaaaactgtcagaactgtatgggaaaggcatgtatcaatgcatgtaaattcggtgccattgaggcgggacgtcatcgttcccacattgatccgcagaaatgtaaagagtgtggacgatgtgcagctgcatgtccttacaatgcaatcgcgcatttgaagagaccatgtaagtttgcatgtccggtcaacgctattacatacaatgaatatggtatttccgtgattgatgattccaagtgtatccgctgcggaaaatgtatccatagctgtccgttcggagcaatcggatctaagacatttatggttgatgtcatcaatgccttaaagtctgataagaaagtatacgtgattgcagcacctgctaccgagggacagtttggtgcaaacatcacaatgggaagctggaagaaagctatgcaggaagttggattcaacggatttatcgaagccggattaggtggagatatgaccgctgcttccgaagccgcagagtgggtagaggcatacaaggcaggagagaagaaagtaacttcctgctgtccgggatttgtcaatatggtgcgtctgcacttcccggagatggcagataagatttccacaaccatctctccaatgtgtgcggtatcccgtatgatcaaagcacaggatccggatgctgtgaccgtatttgtcggaccatgtgtagcaaagaaatctgaggttgtcgatcagaagattgagggcaatgcagattatgtgctgacatacagtgagatgcgtgccattatgagtgccaagggcgtagaactgcagccaagcgataccagctatcaggagtcttccgtatacggcaagcgtttcgcaaactccggtggagttaccgcagcagttgtcgagagcatgaaagagatggaagctggcattgagccgaaagtatgcaaggcaaacggtgccgcagagtgccgcaagttcctgatgcttatgaaggctggcaagctgccggatgacttcatcgaaggtatggcatgtgaaggtggctgtgtcggtggaccaagctcctttaatgatatgcttgtgacaaagaagttccgtgacgaacttcttcagaaagcagatgatcgtcagattcttgacaatttgaagaattatcatatggaaacattctccatgcacagagaagaagagtaatatcaaaatggggccgtcgcttgcgatggcctcgttttttattccacagtggttaaggacaataacagtagctggtgagcagatgcagtcctttgtaaatgtactggcagataatgagaatgcatggcttattacagaaaaacaaagtggagcatgcatcggatatgttacgatggatattccgtatccacagcttgcaattggggagatcggttatgtgattggcgagaaataccagaggaagggcgtgggaaaatgcgcgaagagatattaaggaagcgttaaggttttttaaggaaaagaagatggtttgcagcaaatgaatgtgatatcgtaaacatatggaacatgttagtaagaaaaagaaagggaaatggttatgttagaagttgtacatgtgacaaaacgataccgtaaggtgcttgcaaatgatgatattaatcttgccatagaggatgggcgcatcggagtactgcttggacctaacggtgcaggaaaaagcacgattataaaatgtattatgggatttctgaaatatcagggacagatacaggtaaacagtctcgaaaataagtccatcgaggcgaaaaagatcatgggatatattccggaaattccatcattgtatccgaacctgactgtggatgaacatatggaatttattgcacgggcatataaattaaaggattataaagcctataaagatgcattgctggaacggtttgatctgacagataagaagaaaaaattcggggatgagctgtcgaaagggatgcagcagaaactgtccatctgttgtggacttttgccgaaaccacggctggtactgtttgatgagccaatgatcggactggacccacatgccatcaaagaactgaaaaaggtgtttgaggaattgcgggacagtggctgcatggtactggtcagcacgcacatgattgacagtatggaagaattatgggataccacttatatcatgaaacaggggcgggtagccgctgtggttgagcgtgaaaatttaaaggataacaataaaagtctggaagatattttctttgagattacagagggcgcggctctggagagagaggtgtaggtgatgcggttatggggttattatgcatggcataccttttggaacacgataaaaaagatgtttcgaagtacatttctcgtgatcattcttgccatttttggatttggaatcatatttggactgattggtggcgtggtcggttccatggtagaaaagcaacagtcgctggaaactgtggaatcgtcttcggaggcggatcgcgtacaggaagaagcaatggaagaggaagaaacgcaaaaaacgccacaggagattgccgcaatcaaaacctatgtggaagccggagtgatgattgtttttcttgcgatattactttggggaatgtattccggttctaaggacggtacggatattttccagatggcagacgtgaatctgttgtttacggcaccgatgaaaccacagtccgtgttgatgtttcgactgagttttcagatggtggcaacagttttcgcgtccatatatctggtttttcagattccaaatctcgttgtaaatatgggattgggggcatcggcagttgtagccatttttgcagggtggattctgcttctggtgtttcagagacttatgattgtattgacatatacggtctgcaccacacacgaaaaattaaaaccatatgtgtttcctttgatcgtgggaattgttgtactgcttggaatgattgcaggaggaacatatctggcgaatgggcagaacctgcttgaagcagcacatatgacttttgccagtcactggctgcggtatcttccggtcatcggctggtacaaaggcatgattatgtgtgccgtaaatggggaaatgttcccgtttctggtttatctgggattgctgcttgtaagtgtggcggtactgatttttgccatctggcatatgaaagcggatttttacgaagatgcgctggcttccgcgggaaaacgtgcacagatgcttgaggcagcaaaagaaggacgggttatcgcaggaaaagcacatgcaaaaaagcagcaaaaggaaggaaacttaaagggctggggcgcatccgtgttttttacaaaggaaatttattgccgtaaacgtacgtcaaaatttggaatcataaccaatacgatgctgttttacctgctggtcagtgtcggtatttccctgttttgtgtcaggatcatggaggtgtccggatttctggtgccgggctgtattttgttttttgtacttttcttccggaatatgggaaatccgattgcacaggagactgcgcgaaactggctgtttctggtgccggagaatccatacaagaaagttttcttcggagtgcttgcaggaacatccctctgcgcgatggatctgcttccggcactggtggtttcggcattgcttttgcatgaaaaaccgggaattatgcttctgtggtatctgacgtatctggtggcggattttatgttttcggaagttgggcttttgctggaagctcttgttccggcgtctgcgatggatacggttaagagtatgatccagattttgctgcgttgcattattttagtaattgttgccgtttttctggcaattggatatttctttggcggaattgcaggggctttagtgtttacctgtgcagcttctgccggaatcggcggagcgatttcactgatttatccatggatgctgcatcagggcagataggagactgctcgcagctcatataaaataaaaaaaaattgcacttgccgaacatttgttcttatgatatgatgtaaaaaagaacggatgttcggcacttttgcggagggatactggatatgagagaaattttgcagatggatcgtatcatggaaaaactaaccatactttcggcagctgccagatatgatgttgcgtgtacttccagcggggtgcagcgtggaggagatggtacacatacgggaaacgcatatgcaagtggaatctgtcatgcatttaccggggatgggcgctgcatttcactgcttaagattttatataccaatgattgtatctatgactgcaaatattgcaggaaccgttgcagcaatgatgtgaagcgtgtcagttttacaccggaggaaatctgtaagctcacgatggaattttaccgcagaaattatatcgaaggattgttcttaagttccggaattttacattctccggattataccatgggacttttatatgagaccctttatttattgcgcataaaatatcattttaacggatatatacatgtaaaaggaattccgggagcatcagcggatctgctggaattaacggggtatcttgcagaccgcatgagtgtaaatttagaacttcccacggccgatgcgctgcggcagattgcgcctaacaaagtgcgtaaaaacatcctttccccgatgcgccagttacagaatggaattcggcaaagccgcgagtttcacggggtatcgagtatgaaaagccggatgtatctggatgagaaaacctattataaccagatggcagagatgaaggaaagttatgcccgtctgcaggactaccacgacggaattgctgccatccgggagcataaagcgcgacagagtgcagtacaaagctggggagaagaaattgccggtggggagaattccagcagagtgagaaacgtgcaaaagaagcttccgcagacaacgcggggattgatgcggccggatcattattttgtgccggcaggacagagtacgcagatggtgatcggggcatcggatgaaagtgattatcagatcatttcggtttcagaagctttgtatcagaagtttgagatgaagcggatattctattctgcatttatcaatgtgaatcatgacagttccctgccagatttgcccggaccaccattgttacgtgagcacaggctctatcaggcagattttctgttgcggttttatggattccgcgcagatgaattgctgtcagagaaaaatccgaattttaacgaacagattgatccgaagtgtaattgggcagtgcaccatctggaactgtttccggtggaaattaatcgtgcggattattatacgctgcttcgtgtgccggggatcggaacaaaaagtgcccgccggattatggcggcccggcggtacgcaaagctggatttttcagatttaaagaagatcggtgttgttctgaaacgggcagtgtattttatcacctgtaaaggaaagatgatgtatcatacccgtatggaggaaggatatattacacggaatctgatgtatcaggaacgtccgatgcagatgctgctttcggatggaacggtgcagacctatgagcagttatcactgtttgatgacagggggaaaattgtagtatgagtgaacagatcgtgcttcgatgtgaggattctctggaaggaatttttacagcacttttcgatgcgtttgtgtgcaaaaataaaatgaaagctccttatacagacagtatttccattgcggccggtgaaggagaaatgactttgtttgccagggagatcgaagtacagacagatgcgcagaaagtgcagaagacggtttacagtatacagtcgagactggggtatccggtgtatgatacactgcttcatgcattatgccattttgcagaggaccgggggacagcagttcttggatatctggtgcgtgcatttgcacagggacgtggtatttccgatcagcttgccgatccgtttgcacttcgggtgatggagttgtcccgcaaggtagacaatgagctggataagctgctgggatttgtgagatttcaggatctgggaagtattcttgtggcgcagcttgcaccaaaatgcaatatggttccattgatgatggatcatttttcggatcgttttccggatgaaaattttattctctacgatgaaaaccgaaaccttgctgccgtccatgaagccggacaccgctgtgttctggtgagtggagagcagcttcagattccgcaggggcatatggattattttgctgtgctatggaaacagtattttgccaccatggaaatccgggagcgtcacaatgagcagtgtcagaatcagcttctgccaaaatggtatcgcaaatatatgatggagtggaattaataaatagaaacgaaacttgaaaacatttcttaaaaccaatataatgaatagagttgcagttataaaactatggcagaaaagaatgatagcagctggcacataggaaaattggaggaatggaaatggaacgttgggatatctacgataaaaataaagtgcggacaggaagaaccatggagcggaatcatttcaatctggcagatgatgagtatcatctgacggtacttggtgtgatcaggcgtccggatggcagattcctgattactaagcgtgtgatgaccaaagcatgggcacccggatggtgggaagtttccggtggtgctgcgcaggcaggcgaagaatcggaagaggctgtgcgcagggaagttttagaagagaccggactggatgtaaaagaagcggaaggtggttatgtatttacctatcacagagaaaatccgggcgaaggagataactatttcgtagatgtttatcgttatacgatggatgttacagaacaagatgttcatctgcagacggaagaaacagacggatgtcggtttgctacaccagaagagatcagggaactcgcagatcagggaattttcctgcattatgatagtatcaaacgggtatttgaggactaattacaatggataggagaatacttgaaaagatgtattcccatacgcaaaaaaaggaatgttgcagaaatgcaacattcctttttttaatcgttgtatccaatatcttattctaaagaaagaaaaaggtacatagaaactagattagtcggcaattatttcactactgttacgttaactgcctgaggacctttagcgccatcagtgatttcgaattctactgctgcaccctcttcgagagatttgaaaccctccatgttaagtcctgagtaatgtacgaatacatcgtggccgtcttcagcggtgatgaatccgtaacccttctggttgttaaaccattttactgtacctttgttcatcgaaagtacctccaatatatttgtgttgccttgcaactatgctaagaatagcataaccaattggaaatgtaaagcaaaatcttcgtgaaatagccggattttaaagcacttcaaaagaaatgtcgtgttgtgagagaaattgtctgacaaatttgtcccattccggttctaatgtcttatctgtagaaaaaatgcgataagaaattccggtagtcagtgtaagcatctgattttgaaatttgatgttcatggacatggcggaaatatctgccggggtataggaacttccgattcgttccatggtgcgtttttgattttccggcgacagcatcaggatgaatttaaaggaggatggagcctttttccctttgatcaggtcaaagatgcgtggacggagcatggaaaatggaagaaaatgaaaagttttaataccgagttcttcggcttctgtatctgtatagaatcctttggtaatagttccatcaatcacatagcttgcaaaagaaacgacaatgccctcctgaagcagaaaatggtcaaaaatttcagttttgagaaatttattcataaaatcttttttgtttgttaatgcaagagccagcataaaaaacctccccattgtgaaaccgataaaacggcagctgatatagtttaattttagcatgagtgacttcatcttttcaatcataatgtgttataatgccactgattgatagaaaatgcacggttactgctcacaggttcccctgcgaaccgtaacgatgcaatcacttaagaaaagaagggaaactataactatgaaagaatcatttttgatagatgttttaaaaaaaggagtatcaccgtttcattgtgtggaagcagccatgcagacgttagaggaatccggctttgaggaactggagtatgccagaccatggaatctgaaaaaaggaaaggcttatatgatgaatcatcatggaacaacgctctatgcatttacagttggagaaaacttccgtgcggatgcaatgctgcgcatggcagctgcacatacagattatccatatctgcggatcaaaccaaatgcggattttgtgacagaccggtatgcgcaggtgaacgtggaagtatatggcggaccaattttaaatacatggtttgatcgtccactggggattgcggggcgcgtgatcgttcgaagcggggatgtgtttgccccgaagaccatgctgtatcgttccggtcgtccggttcttattattccaaaccttgccattcacatgaaccgggaagtgaataagggagtggcaatcaataatcaggtagatttgatgccggttgcggatatgctgccagaagaacagcagagtaccgattatttcctgtcatttcttgcggaagagctggcagtaaaaaaagaggatattctggattttgaactgaatacttactgtgtggaagaaccggcatatgtggggataaaagagacactgctgtcttctccgcggctggataaccagacatccgttgcggcactgctggcagccatcgtggaaggaacacggaccgatggtatcaatctgatcgcactgtttgataatgaagaaatcggaaataccagcaaacagggcgcagcatcgatcttattgcatgatatggtaaaacgcatctaccggtcgcttggctgcagtgaggaagaaacggattgtgcgatgtatggaggtatgctgctttccgtggatgtggcgcatgcactgcatccgaatcataaggagaaaatggatattaccaatcatccggtgcttggggatggattctgtatcaaagaggcatgttcccagtcttatgcgacggatgcaaaggcaatcggaattctgcggcagctctgcgatcagaataaaatcgcataccagaggtttgtcaatcgttccgatgtgcgcgggggtggtacactgggatcggttgcatccacgctgtttccggtccgcacagtggatattggaattccgctcttatcgatgcattctgcacgggaactgatgggacgaacggattttgatgctctggcatcagctgtgacggcatatttttcctgaaaaatatgaagaaactataaaatatgcctttttccccttttcaaatatctgaaaccgtgttatgatatgaacatagtaatgaatactacatgtaatagaaaataaaaactttttataaagtaatgataaacacacgcacttcataaaatgatagacgtattttagaaaagagggatggatatgagtcagtataaaattgtaattgacagttgtggagaacttcctgaggatttaaaggcagatggacatttttgcacagtgccgcttttgctggatgtggatggatatcagatcacagatgatgaaacttttaatcagagagatttcttgcagagagtaaaggcatgtattcacagcccgaaatcttcctgcccgtctccggagcgttatatgagtgcgtatgagggagaggcggagcatgtatatgttgtgacgttgtccggaaaattgagcggatcgtacaatagtgcggtacttgcagcacagctttaccatgaagagcatgaggattccaagcagattcatgtatttaattccaagtcggcctcgattggggaaaccctgatcggattaaagattcaggagctggaagaatccggtgcatcttttgaagaaattgtaacagaggtggaatcttacatttcttccatgaacacattttttgtcattgagacacttgaaacactgcgcaaggctggccgtctgagtggactgaaagcatttgtggcaaatactttaaacatcaagccggtaatgggatccactaaagagggaacgattcagcagcttggtcaggcaaggggcatgaagaaggcactttccaagatggtagaggatatgctcaaagtaaccaaaaactgcgagagccgtgtgcttgccatttcccactgcaattgtccggaacgtgcacagtttgtgaaggacacaattgagaaagtcgcaaaattcaaaaagattgtaattgtcaatacagccggggtatccagcatgtatgcaaatgaaggcggagtgatcctttcggtataggattttgcacttgaaacaaccgtcatatagaagtagaatacggggagaagctttttataagcttctccctattttttgtgagtcaggtaccggctgccgaaagcggtttacagatacctgcagggagaataaagatgtattcatatgaagaagtattggatcagatagaaaatggaagacggtttggaaaccggccgggagtggaaattaccggaatcatgttagaacagatgggacagccgcaaaacgggatgccatttattcatgtggcgggaaccaacggaaaaggatcggtctgcgcattcctgacatcagttttccgggaagccggattaaaagtcggaacatttatttctccacacctgattgattttgaagagcgtatcatggttgatggcagacagatttccagagaagatgtgacacgaatcggcaatgttctgctggagcaggaatttggcgtgacaccgaccatgtttgattattgcgtgcttatggcggtactgtattttaaagaacaaaactgcgatcttgtaattatggagaccggcctcggaggcagacttgattctacgaatgcactgggaaatccggtggtatcggtgatcacacggattggttatgatcacatgaacattcttggaaataccatagaagagattgcgcgggagaaagcgggaattatcaaagctggagtgccggtggtaattgcaccgcaggaatcggaagcacttgcggtgctgcaaagggcagccgcagcaaagggagtacgtgcgcggtgtgtacaggagaaggacctgcagggggcaaaggcactacagccaggacttttgggtgcttatcagagagaaaacgccgctacagccatgtgtgcggcacaagtggcatggaccagatgccggatagaaaaagagaagatgaaaaccgttattgcccgtggaattcacagagcggtatggccggggcgtatggaaattttaagtacagaaccgtttctgatggtggatggtgcacacaacagtaacggaatccatgcattgtgtacaagtctcgaagaattgtatccggaggaaaagtttcattttgtgatgggtgtgatggcagacaaagattatgaaaagatgatcggggaactgttgccgattgccatggattttgtaaccgtcacaccagagagtgcacgggcactgcaaggggaaacactggcagaagatatcagaaaacaaggggtgcctgcacacgcaattacaaaggttgcagagattccggaacttttaacaccaaaagaaaagacgattgcgctggggtctttgtattttatcggggaattaaaaagcgtatatcagaatagggcataacagatgcaggagtatccatatggcattgcaatatgaaacaacaaaagaacatacaattaccgttaccgggtatgaaggaaccataagacatctggtcattccggatcaggtggatggatgtccggtgaaaacgatcggcaaaaatgcattttccgcaagggaagatttagagagtgtaagtattccaaagacggtggaaacgcttggaagatatgcattttataactgtaaaaaactcaaaagcatttcgctgtacgacagtgtggaagactattatgacggcgtgatcaaacagtgccattgtctggaagaagtgaagctgacgcagcttagaggagactattcggtgatgaaagaacttctggcagataccgaccgcaggctgcattttcgcatagagccatgtgggctgcagctgacgtttccggcatatgtatacaattttgtggaagatgtggaggctcgggttctgcatcacaagattgagggaagcgggtatccgtaccgggaatgtgtcacaagaaaaggcgtagatttactggcgtatgaccgtctgtttgcgcaggtggtaaatgatgattatcgcacggcaattgagattgcctgtgaccggctgatgcatccgattgagctggagaaccatctgcgggaacagtacgaacagtatctcgaacagaatgcagaggtgatccttaaggtgctgattccggagaataaggtggaagagatttcctatctttgtgattcctgcctgattccggaagcggcacttgccgatgcccttccgctggcatcggaggaaaagatgagtcagattgtagcaatactgatggaatatcagcggagtaatttcggaaagaagaaagcatccaccatgtctttggactggtaggaaaaggagaacgatgaagacaagggaacaactggaagcaaccggaaataaaatattaaacagtgtcaggacagaactatatctgtcgatgcggtttatgggaccggcactcggaagtctgggatttgccatggatctgtcaacgagaacagtgggcacggatgcggtatatatccggttcaatccgacctatctgctgcagacttatattgaacggccggaaattttaaatcggacatatatgcatatgctcatgcactgtctgttccggcatatgttttccgcaaaacagcacgaggatgcacagctgtgggatctctgttgtgatattgcagtggaatcggtggtggattccatggattatccgaccattttgcgtgtgacttcggatttccggcaggagtggtatgaaaaactggaaaaggaagtttcagtgcttacagcggaaaaactgtaccagtattttatgctgcgcaaacgcgatccgtatctggaagaatccctccggcaggaatttttgctctgtgaccacagtttctggcagcgcatggagaaagaaccgccgcaggagcagaataaaaaccagcccccggtgccgcaggagaatccgcagatggacagtgatcagcaggaaaatgccggggagaaaacgtctgatgcaacgccgcttggaaaaaccgatccaaaggaagacgagtggaaagaacatgcaaagcgtatcgaaagcgatatggaaacctatgcaaaagacgcggcggcagatgcgggaaagcttgcatggatgttaaagctgagcagccgggagcgaaaaagctacaaagaatttttaaagaggtttgcagttgtgagagaagaagtttccgtggatatggattcgtttgattacggattttacatgtatggactgcagcattacggaaacatgcctctgatcgaggaaaacgaattccgggaggcaaaaaagatcgaagaacttgttattgcaatcgatacttcggcctcctgcaaggaaaaacttgtgcagcagtttttgaatgagacggggacaattttaaagcaccaggagagttttttccataaagtgcatatccgcatcattgaatgtgataaccagattcaaaaagatattccaatcacaaatctggacgaaatcggggaatataccgagcagttttccgtttccggagggtatggaacggattttcggccggtattttcctatgtagagaaattaagaaacagcggggaactcaaaaacttaaaaggactgatgtattttacggacgggtatggagaatatccgaaaaaaccgacagattatcagacggtatttgttttttacggggatgacacaccgcagaaaattttttcgggagagccgataaaagtgccggactgggcagtgaaattatatttgtcagaggatacaaaaggatagataaaggagaaattttatgaacatcaaacaggcaaaacaggaaatcataaatacggttcaggcgtacctgacaaaagatgagaccggggagtatgcgattcctgtggaacggcagcgtccggtacttttgatcggacctccgggaattggtaagaccgcaattatggaacaggtggcgcaggagtgcgggatcaatctggtttcttatacgatcacgcaccatacgagacagagtgcgatcggactgccgtttatctcgaagaaaacctatgatggggaggatgtatcggtcacagagtatacaatgagtgaaattatcgcctcgatctatgatcagatcgaacaaagcggaattcatgagggaatcctgtttctcgatgaaatcaactgtgtatccgagacgctggctccgacgatgctgcagttcctgcagtacaagacatttggaaatcacagggtaccggatggctttgtcatcgttacggcgggaaatcctccggaatacaacaagtcggtgcgggattttgatattgttacttatgaccgtgtcaagcggatttatatagaagaagatttttctgtgtggaaagagtatgcgtataaagcgcagattcatggagcaattctttcttatctggagattaaaaagaacaatttctattcggttgtgtcggatctggatggaaaacggtttgtgaccgcccgtggatgggaagatctctcacaggtcatgaaagtgtatgaacagcttggatttgccatagactatgactttgttgtgcagtatctgcaggacgaggagattgcccgcgattttgctgcttattatgaactgtacaataagtataaaaatatttaccgtataccggaaatcttagagggcagtataccggaaaacagtatgacgatcaaaaatgcaccgtttgacgagaagctgagtctgctggggctgcttttggacagcctgggacaggaattcatttcttattcccggaaaaaagctgcacaggaagctttttttgagcagctgggatttttgcggagcgatctgaaagaaggacggggaagcggaaaagaaattctggaaagacagatttcttcttatgacaccatgatcactcaccggaaaaaggccggcatgatagacagggaacaggaaaaagccatgtgtgcggcacttcaggcactgaatgactgcctgatggcactggcagtcgaaggaaccggtgatgcaaaaggagatttcttatgtgtcaagaaactgtttgatgagagggagcagatccgccagaaggaaatttcagatgcaggccgtcatctgacgcatgcatttgaatttcttgcacgggtatttggagagggacaggaaatggtaatctttttgtccgaactttcggccggttattacagtctgaaatttgtcagtgaatgtggcaatgatgcctattataagtacaacaaacttctgcttttgaaagaacgcacacaggagttaaaggacgaagcaatggaacttctgggactttagggaatcaggttatggtttttatgaatttttttgatagagaaatttcataagatctatagacaaatacttcagattgtactaaaatatgtaaaaataatagtatatccagtattccataacgaaaagttatagaacacttgaattggaatagaaaatggaggaaatgaaaatggagaaaaaaaatcttgactggggtaacctgggatttggttacatgaccacagactaccgttatgttgcaaattacaaggatggaaagtgggacgatggagcactggtaacagatcctaccgttacattaaatgagtgtgcaggtgtattccagtattcacagtcctgttttgaaggattaaaagcatacacaacagaggacggacatattgtatgtttccgcccggacttaaatgcaagccgtatgaaagattcctgtgagagacttgagatgccggtattcccggaggagcgtttcgtagatgccgtagagcaggtagtaaaggcaaatgcagcatgggtacctccatttggttccggagcaacgctttatatccgcccatatatgatcgctacaaacgctgttatcggcgtaaagccggcagatgagtatcagttccgtattctggttacaccagtaggaccttacttcaagggcggcgcaaagccaattacaatccgtgtttctgattttgaccgtgcagcacctcacggaaccggacatatcaaagccggtctgaactacgctatgagtttacatgcaatcgtagatgcacatgctcagggatatgctgagaacatgtatctggatcctgctacaagaacttatgtagaggagaccggtggagcaaacttcattttcattaccaaggatggaacattcgtgacaccaaagtcagacagtattttaccttccattaccagaagatccctgatggttgttgctgaaaagtatctgcatatgccggtagagcacagaccggttaaattctcagaagtacctgattttgcagagtgtggactctgtggtactgcagccgttatttctccaatcggaaaggttgttgatcatggcaaagaaatctgtttcccgagtggaatggaagaaatgggaccatacacaaagaaactgcgtgagacacttaccggaatccagatgggcgagattgaaggaccggaaggctgggttcacaagattatgtaagtctatgagggaactgttttaaatataagtgttttctatgtgacggaagacggggtacattctctttctacagaaaaatttacaaagcagcgccgatattgatttcaggttggttttataaaagttttacgtttacgctattagcgttatgcgatggaactacggcgcagttgtaaatttattcttccgaaagaaatgtaccccgttttcctgttggttgggaaaattataagtaaaaacgattcttacaaattctgtaaatgggatctattgataaaaaatagtgattaaggtgacacatttctttattttcaatgcctaaaataaagaaatgtcacctgtaagagaaaaattgcttcttcaggtaccgattatttgaaaaaatggtacctgaagaagcaatttttatttcatagagactttgtggtatctaaatgttaaattttaagtatatagataccataacggtatcttttatacaaattttctttgtatagataccaatacgtttttcaaattatcttttctccaaccaacaggaagaaggcgtatatttctttcggaagaataaatttgcaactgcgccgtagttccatcacataacgctaatagcgtaaatgaaaaacttttataaaaccaacctgaaatcaatatcggcgctgctttgtaaatttttctgtagaaagagaatatacgccttcttccgtcattttgagaaaacttatatctaaaacactcgtacaaatccacagcatcgaaaaaagcattgacagatacgcaatatgtgagaagatagaaataagccccacaaaggggcaaaaataatacaggagatatgcatttatggctccaacctatcgaaagagatataaaaaacgaagaacaagaaaagaacagctgcagatgcgcattttaatgattctcattgccgtaattttgctgggatccattctgggaatcatacataaagtgaagcaggaacgggcgcagcagacggtgtctgacagcagctgggatattacagataaaaaatacgttgaccagagaccggaattagacgtggaactgcttccggtcaatgaatattcccgtccggggcttgcacttaaaaaggttcgtggaattgtcgttcattacacggccaatccgggaacgactgccatccagaatcggaattatttcgcagggctggaacaatctcaccagaccaaggcaagcagtcatttcgtgatcgggctggatggagaaattgtacagtgtattccctgcaatgaaatcgcatatgcatccaataaccgaaacagtgatacaatcgcaatcgaatgctgtattccggatgacaccggaaaattcaatgacagtacgtatcagtcattgatcgagttgacaacctggctgatcggaagatatgatcttggaattgaagatgtgatccggcattatgatgtgacaggcaaaaactgtccgaaatattttgtggaacatgagagtgcatgggaagattttcatgatgatctggcggcttacatcgaaaaaaatggagtagacaaagaataaaaaatcatctacaataaattaaatataggaagtattctgcataattaacggaacagaggagaaatttttgatacaactatttacggaattacaggaaaagaaaaatgtaaggagtaatctgagtgctctgcgtgccagcctgaaagaagcaacggaagagcaaaaagcgcaggctatagaatttgtacgtgggcatgaagatctggtgtttggatttttacaggaagaggatgcaaagacgcggaagaatgcagcacttcttctgggagacctggcagtacagaatgcgttgcagccgctctggaaagcatatacccgggaacagacactgttcgtaaaaagtgcatatctggaagccatgaaggcacttcatgcagaagaaatcctttcgcagctgaaagatcgtcttgcagagctggaaggagagccggtcaccgaagaaaaccggaaacactgggaagcagaactgcgggcactgcgggcaatcctgattcagtatgaaggaatcgatacccatcattttgatataaaacaaaagaacaatcatgtacttttggtgacaaaccgcaatcatcgcggaatactggaaaatcagaccggtggaaaggtgcatccgctcggtgtgattgtacagacggatgatctgttgcagctgttgcagatccgcacatatcgggacatgctgtttttgattccggtcaaaggacttctggagcaggaaccggaaaaagcagcagagacggtgtggaagccaatgcttgcaatctgtgcaaaataccaccgggaagacaagccattctttttccggattgagtgcagatccgcaatgacactggaacagagaagccggtttgtcaaaaagcttggatctgccattgaacagttgtcggatggaaaactggtgaattctccgggggattatgaggtagaacttcgactgattgcaaatcgtgagggaaagtttttcccggcactgagattttatacccttccggatcaccggtttgcgtaccggaaacatgcaattgcagcttccatgcacccttctcttgcggcattgattatggaactggcagcgccgtatctgaaagagaatgcacagattattgatccgttctgcggcgtgggcaccatgctgattgagcgggatatccgcgtcccggcacgtgaaaaatacggtacggatatttttggggaggcaattgacggagcacgggagaatgcggctctggcgggagaacagatcaatttcattcacagggatttcttcgatttcagacacgattatttgtttgatgagattgtaaccaatatgccggtgcggggaaaaatgacgcgggagcagctggaccgtctgtatgagaaatttttccggaaagcattaaccattctggaaaaggaagctgtgatcgtgatgtatacaggagaaatcggatttgtgaagaaacagttgcgtcttcacagggaattctctcttttggaagaatattgtatgcagagtaaggcaggatgttatctgttcattataggagtaaagaggtaatggcatgaacggtgatacaaatctgatagatatatcaatgttacagcaattgcaggatcagttttgctgtgcagatcatttgtatctgatgtgtgtggataaaaataagggtgttgtgaccaaaccgtttggaacggaagaacaggtggggtttttacgtacacaggtagataaacatgcctacatggaactggtagaccagatgcagcatgaccggatggaaacggttgtggagcgggaaacagcacaggatttcatgaaattgtgtgctgtttccacaaaagtagaagatcagctgcaggttgtctggattgttatgggcattataaaggagcggctgacaccggaggttcatctgccggagggaatgcttattacgacggaggagcagttttacgcatcggtagaatttttatcaatgctttccggacagttgtttgagagtcgcagaaatcagatgattgcgcagaaagcggttgaaaagagttctgtttccgagctggcgatggaataccagctgcaccgcagccgggcaatgaccgaaattttgcagatgatggattcggataacagttttgaaaaagtggctgaggatattttgcgggagacatgtgaaagtctggaaatttccggtggatgtctgttgcgtgagaatacaggggaaaatacggcagacatgatctgcgagtatacaaaagaaccagacaagtccattcttgcagaggggcagcatattccgatcgatgcactgccgttttataatggtaagccttatatgatctcatcggattccatcatgccggaaccgtttgcacatttatttaaaacctgtcatatcagtgctggaatttttgaaccgattgaaatacaaaaccgcacggcaatgtatttttgcgtgtatgataatgaaaaaacaagaatctgggagaacagagatatcaaatttgtcagtgatgtgcgaagagttgtgcagagcatcatgctcaaaagaattgcaaagaattcgctggcaagttcctatacatctttagaggcaattctggaaaataccggatgtggaatatatgtggtcgattatcataccaattcgattctttatatgaatcacaaattcaaagaacttttctctcgcagtatcgcaggaaatcatctggaaaagatgcttttttccgaccgggagacaaagcgcagccagtattatgaggaaatttattcggtggttgaggaacgctggctggatgtgcataagaccgagattgactgggtggatggcagaaaagttgccatgtgtacactctatgatattaccgaaaagaaaatttatcagaaagaaattgaaaatcaggcgaacaatgatttcctgacagggttgtttaatcgcatgcgctgcgaacaggatctgggacagtttatacgaaagacccgggaaaaagatgcaacaggagcgttgctttatatgggactggatgattttaagcatatcaatgacgggctgggacaccagtatggggatattctgttgaaagcgatttcccatagcctgcgcaggatagatgggattgagaatacctgttaccgcatgggaggggatgagtttgttgtgattattccggattccgtgtatccggagctggaacggattgtcagggaagtgacatccatatttaagaaaccatggtttttaaagggagaagattattattgcaccataagtatggggatcgtatatttcccgaaggatggagaaacggtggaagaacttgtccgtaaagcagatattgccctgttgtcggcaaaacgcgggggcaaaaaccgcgtggaatactatgatgggatggacacatcttcctcataccgcagactggatctggagaaaaatatgcgtactgcagccatgaatgcatgcacggaatttgaagtgttttatcagccgatcattgatgtctgtcagccgggagagccatgctgtggtgcggaagcattgatccgctggaattcaagtgcacttggatttgtgaatccggcagattttattccacttgcggaatatctgggactgatcaatccaatcggtgaatatgtaatgaaaaatgcggcattgcggtgcaaatactggaatgatatggggcatccggagtatcatgtcaatgtaaatttgtcggttgtacagctgttgcagaatgacattgtaaagaaggttgcaaaggttctggaagaaacccgtatcataccacagaatctgacgttggaagtaacggagagcctggcgatcaatgatatggtacggatgaagaagatattaagtgagatccggaatcttggtgtacgcgtggcactggatgattttggaacaggatattcatccctcaatcatatccgtgagatgcctttggatgtgatcaagattgaccgttgttttattgaacatcttggagaggacgacttttccaatgcatttgtgcggatggtatcggaactggcaaatgccatcaatgtacgcgtatgcgtggaaggtgtggagactaagcgccagagagatattgtaaaaaagatgggaatccgtatgattcagggatttttttatggaaaaccgatgaagattgaagaatttgaaaagaaatatctgatataaggaggatgatatgtacacagcattaacaattgctggaagtgattccagtggaggcgccggcattcaggcagatattaagacaatgacagcaaaccatgtttacgcaatgagtgcgatcacggctttgactgcccagaatacgaccggtgtaacagatattatggaggtaaccccgaagtttttggcagagcagctggatagtatttttacggatatctatccggatgcgattaaaaccggaatggttgcttctggtgaactgattgggacgattgcgcagaagctgacagagtatcacgcaaaaaatattgtcgtagatcctgtcatggtggcaaccagtggggcaagactgatcagtgaggatgccatcagcacattgaaaagtaaattattaccgcttgcaacggtgattacgccaaatattccggaagcggaagtgctttccgaaatgcagatcaagaccgatgcagatatggaaaaagcagcagaaattatttgtgacacattgggctgtgccgttttattaaaaggtggtcatcagttaaatgatgccaatgacctgctctaccagaagggtaaagagccggtatggtttgagggaaagaggattgacaatccaaatacacacgggacaggctgtacgctttcttctgcgattgcatcaaaccttgcaaaaggaagagatcttgaaacgtccgtgaagtatgcaaaaaattatatttccggtgcacttgccgccatgcttgaccttggaaaaggaagcggaccaatggaccatgcatttgcaattgaaggagaatattagtatccggcaaatgtgaggccgggtttatcataggttaagaggagtgtacaaatggaaaaaaaaggaacttccgtgttcagtaacggattaatttggtttggagcaggtgtatccctggcggaaatactgacaggtacttattttgcaccgcttggatttggaaaagccatggcagcaattttactgggacatctgatcggcggacttatgatgtttgcagcaggaatgattggagcgaaagaacgaaaaagtgccatggaaactgtgaaaatgagttttggcgagagaggaagccttctgtttgctgtcttaaatgtgttacagcttgtagggtggaccgcaattatgatttatgacggagcacttgcggcagacggggttttgcataccggaatctgggtatgggcgatcattatcggcgcactgattgttgtctggatttttgtcggacttacgaatcttggcaagttaaatacggttgccatgaccgcactttttattttatctctggttctttttaaagtgatcttttttggaaccggaagcgcggctccggtcgtggatgatggaagtcttacatttggtgcggctgtggaacttgccgtggcaatgccgctttcctggctgccactgatcagtgattatacaagagaagcagaaaaaccgtttgccgcaacacttgtcagtgtggttgtctacagtctggtcagcatttttatgtatatgatcggtatgggggctgctatttttaccggcgaatatgatattgcgcagattatgttaaaaacagggtttggcgttgtgggacttctcatcattgtattttccacggttacgacgacgtttctggatgcatattccgcaggagtttcaagtgtttccatttcttcaaaaattaaggagaaatgggcagcgattgttgttaccgtgattggaactgtggcagcaattgtttatccgatggataacattacaaatttcctgtatctgattggttctgtatttgccccgatgattgcagtgcagattgcagattatttcattttaaagaaagcagatgctgaggaatccgcttttcagtggagaaatcttgtggtgtggctggtcggttttgtattgtaccgggtgctgatgcatgtggatacaccggttggaaatacgctgccggatatggtgattaccgtaattgtctgtgtgattgtagaaaaaattgcagcagcagtaaaagaaaaataaggtgttatcatcctacacctattaatcataagactttttgtttgactttttagaaaaagagaaatataataattttcaaacgagtagcaaacgagcgtaaatccagttttgttgctcgtttttaattttataatgccatgaaaaagtgtgtagcttatcagcgtaagtccagcttgtgggataagtacatgctttttttatgtagaaaaaggaggattcagttaagatggcagaaagaaacaggatgaaggagatgccggtcaataagctcatggtacagatgggaataccgatgatcttgtcgatggcattgcaggcggtctacaatattgtggacagtgcctttgtcggaaacatgaaggagggaagtgaagccgctttaaatgcacttacgctggtgtttccggtgcagatgctcatggtagcggtaggaatcggaaccggtgtggggacgaatgcacttcttgcgcggacacttggacagggaaacagcaaaaaagcagcaaaagttgcgggaaacagtttatttcttggagtaattatttatgcggtatgtctgctgtttggaattttcggagtgaaagcctatatttcatcgcagacggttgatccggaagtaatttcgatgggaaccggctatctaaggatatgttgtgtgatttcgtttggaattatcttcttttccctgtttgaaaagttattacaggcaaccggacgttcactttattctacaatcggtcaggttgtgggggcagtggtaaatattattcttgatccgatcatgatctacgggatcggacctgttcctgaaatgggagtagaaggtgctgcatatgcgacggtaatcggacaggttgcatcggcagtattactctttattttccatacgaaattaaataaagaatttgcgcatggaacaaaatacatgaaaccggagggtggaattataaaagagatttattcgatcggacttccggcgatcattgcacaggcattgatgtctattatggtttatgtaatgaatctgatcttaaaatttaatccttcggcgcagaccgcatatggattgttttataaagtgcagcagtttgtgttgttccttgcatttggtctgcgtgatgcgatcacaccgatcatcgctttttcttatggaatgggaagtaaaaagagaattaaggatggtatgaagtacggactgatttatacaatcgtacttatggttcttggtgtggcgatcacggaaattttcccgggtgcatttgcaactttattcaacgcagcgcagtcaagagaatattttatcggagcaatgcacattatttctatcagttttctttttgcaggaatcaatgtcgcatatcagggaatttatcaggcattggacggaggcatcgaatcgcttgtgatttcgctgcttagacagcttgtaattatattgccgttggcaggcattttctctattttcgtccgaaacggacagatgggagtttcgctgatctggtgggcgttcccgatcacagagtttatcgcgtgtctggccggctatgtatttttaaagagaatatggtgtatgaagcgcagaggaaagtgattttggagattgcggaaaaggaaagctgtgtgatcataggacggaatgcggattttatcttaaaagacaaagataatgtgctgaacgtttttatacatggggatatgccggaaaaggtggcgcgtatctgtaaactgtataatgttaccgaagaggaagcagaaaaaatgatggcagatatcgataaaaggcgtatgacaaattatcgattttatacggatcagaagtgggggatggcaaagaattatacattgtcactgaacagttccgagcttggatatgatctgtgtgagaagatcataatggattgcaagaaatagaagaaaacaaatgtgcaattaagagataccatacatgtgacacccagatctgacggaagttgttttgctattttttcagtatttccagaacgggaataataaatgataattgcattcatataactcttcctttcattatccaacactgtgttgtacaatattataaaagttagagaaacgtttatcaaccaacaaacagatgaactggcttcgttgatacacattttatatattagtggagcacagggagtgttgttggattgacttgtccttaaaatgcggtaaaatttaagggaaagaatgaaaattaggggaatgagaaatgaagataagaacagcaaccatggatgatcttaacgagattgcaaatgtagaggcagagtgtttcccagcagcggaggctgcaacgaaagaagaatttgccggtcgaatccggtattatggaaatcacttctggattatgttggaggaagacaaactgatcgcatttgtagatggttttgtaaccgatgaggcggatttgacagatgaaatgtatgagaaggctgctatgcacaacgaggatggtgcatggcagatgatattcggtgtcaatacacttccggattatcgtaaacacggatatgcaggacaactgatccaatgtgcaatcaaggatgcaagagagcagggcagaaaaggtcttgtgttgacctgcaaggaaaaactgatcaagtattatgcaaaatttagttttgttgatgaaggcgtgtccgataaatccacacacggaaacgctgtgtggcatcagatgcggctgactttttaattcattgtaatgcgtataagtaatcgaaaaatcaatcgtatttttttacgattgattttttgattgcttttgcatataaatagcttacattgtttttgcaacgattttctcatcgtcattctgaatctcgttggtgcttttttctttcttatgattgataaataatgtccggaagatcagtcttgcaagcggtcctacaaaaataagctgcagcggaaatgccatgataaaatttttgcaataggtcataagataatccggtataaagttggcggtaaatccatgtccgtgatagacaccgatcacactggcgaatgcaacctgccagattaccgtgaaagtctggatcgcaaagatgataaaaatcggccggtcgccaggctggacaacgcggaaggcgcacatttttgagagatgaccggacacgaaatgggcaagcaatccgatgatgatatactctatccacattcccttcaatgcaataagaaaggtcgtatttgtaaagcttcctgttgcgagtaccgtgttatagactgtcatgacatagaccatcatccatgcggtgatcgttgtaaaaaatatggattctcctcgtgttctaggcattttcttttcctccgttgtatttttgaatcgcatcaagaatgagtttcataaccatagtgtttcctttccgacaacaaaaaagacaacaaatgctgcccgtccgtctgacagtggacaggtgacatttattgtctgatatgtgtcttgtatttaatttgtttttacaactcttgcattttagcagaaaaatgaaattaaagtcaagtaaaaaattttttacggttgttttctatggcgtttccggttgttaataaattctatgcatgctatattggtaggagtgaggtaagagtaacgaggataagaacagcaacaatggaggaaaatcatatgggtttggtccaagcgttacgatagcaactgcgaatcatccgattgagccatcacttcgtgaaaatgcgatgcagtataacaagaccgttcatattggggaaaatgtctggatcggcgcagggactattatagttccgggagttacaattggaaaagattgactgggaaaatctgtagaactatgataaaactaacaaagaaagttaaaaagttataatggcctcgattttctttaccattgaatttttttttaaaagatatggtatactcggtttaatcagttgaacgaaagcgaggatattaaaatggatatattagagaccatgaaagcacgacacagcgtaagacagtataaaaatcaggcaattgaatcttcaaagagagaaaaaatcaatgcgttgataaaagatgttaatgcggaaagtaaactgtcgatacaggttttttacgatgaaccgaaatgttttgattcatttatggctcattacggaaaatttgaaaatgtaaagaattatatcgcgattgtcggaaataagaatgatcaggaaaaggcaggatattatggcgagaagattgtgctgaaatgtcagaaacttgggcttaatacctgctgggtggcaatgacgcatggaaaatcaaaagcgcagatcaaaagaggacagaagctactcattattatctcactgggatatggagaaacacagggagttccacataaaagcaaaagtatcgcagaacttggacaggcggatcagaagaacgaatggtttgaaaaaggtatggaagcggtaagtcttgcaccaactgctgtcaatcagcagaagttttattttgaactgaaaaacggaattgtaacagccaaaaatcttggtggtttttattccaggattgaccttggaattgtaaaatatcactttgaggccgtgacaggacatgaggtaaaataatgccggacattattatcgtagaggacaacagggagatcggaacacttttgtgcgatttcctgcgaaaagaaaattatacggtgagccttgtggacaccggggagaaggcacttcagatctttgagcagtacggtgccaatcttgttgtgattgacatcggtctgccgggggtggacggttattccgtttgttccaaaataagagaaacctcaaacgcacacattatgatcgcgactgcaagggatgacaaggaaagtacgttaaaggggttgcagatcggcgcggatgattacatctgtaagccgtatgacatcgatattctgatcgccaagatcaacggcatttttaaacgcaaatatgcattggatgaaatcgtatgtgacaatctgaaattgaacaatgtcacgcagacactcaccgtgaaccaaacaccagtcaatgtcacggaaaaggaatttcagctgctgaaacttctggtcgaaaataaaggaacgacattgaagaaagaatacctgttcaaccgcatctggggaagcgacagtgaatcggagctgcagacgctcacggtacatatcaagtggctgcgggaaaagatcgagcaggattcgaagaagccgaaacacattattacggtttggggaacgggataccgatatgaataattacaaaaaatttgcagcgaagttttgtggagtggagctgcttattattgcacttgcaaatatcgtttattatgtgacagcaaataatcaggaaccgtgcatttcgcgtgtgcaggataaaaccgaaacaatctacaagatcatttatacacagacagactacagaacctggattcttatggacgttgtccttggaattctgtttttgctgtctgtttttttgatctgttatatcggaaagaagatcataaagccgtttgaacagatgcaatcgctgaccgaggagctggcgaaaggaaatctttcggtgccggtcaaagccgaaaaaagcaaattcttaggcagattcctatggggaatggatatgctgcgcgaaacactggagaacaacaaagaaaaagaactcgcgttgcaaaaagaaaaaaagacgctggttctttctctgacacatgacatccggacaccgttatctgcgatccggctgtatgcgaaggcactggaagaggatctttatacgaccggggagcagtgtgtcggagcatgtcaggggattggaaaaaacgtaaaagagattgaggagtatgtcaatgagatcacacttgcatcgagagaggatttcctgcaactgagtgtcaatccgggggaagtgtatctgtcccatgtgatcgatgcgatccggggactttatgaggaaaaactgcataatttacataccggatttcagattgcatcctacacggatctgttgctgaaaggggatgcggaccggctgatcgaggtgttgcagaaccttttggaaaacgcgatcaaatacggggacggcaagtgtatttccatcgacttttcggaggaagaggactgcagactgatcacggtaagaaattccggatgcagcttaaagcaggaagaactcataaatctgtttgattctttttatcgcggaagcaatgtcggctcgacggatggttcgggactcggactgtatatcagccggcagttgatgcaaaaaatggatggggaagtatttgcggaaattaaggaagatgatttctgcgcgaccattgttgcgcgaaaagcataatgtgcatttaaggattgtttaataatttctcctgtaagatgaatacatcaaacgaggggaggaacgttaaaatgctttttcgtattttgaaaaaagatttgaaaagaaaaaaagtaatgaacgcaatattgctttgttttattctgctggcaacgatgttcgtagcgagcggaattagcaatgttgtttccgtcatgaacggaacggattcctatctggataaggcggggatcggcgattatgtggtcatctcgatgggtgcggacagcaaagcgtccatcgatgagatcctgcatgagatggaatccatccgggattatcgcattgagccggttgtattcggagaaaaatccaatctgaaagatatgcacggagaaaaactggaggcaaagaattctgttatttaccagtccatcgaggacagccggcttaaattctttgataaagagaataagcagattacccagatcaagccggggcatgcatatgcaaccggtgattttatggagaaaaatcatttgcagccgggggataaaatcaggattacgcacaacagtatttcttttatggtaacgctggatggtatggcaaaagatgcgcttttagggtcttccatgatgggcaacagccgtttcctttttcatcgggaggagatcgagaagctgctttcggatgaaaccatttacaatgggtatcaggggcagatcagctatattgatctaaaggatgaggcaggcgtatcggagattgcttcggctatttcacaggctccgggcatcatgttttccggcgcacgttcgctgataaaaatgtgctatgtcatggatatgatcgttgcgtttacgatgctgattttaagtatctgcctgatcatcgtgtcgtttgtcgtattaaagttttccatcacgtttacgatctttgaggagtttcgtgagatcggtgtgatgaaagcaatcggtatcagcaatttcaagatccggagtctctacctgacaaagtatctgatgttggcagtaataggagcgtttgtgggattttttatgagtatcccgttttctgatctgttactgcgatcggtcagcagcaatatggttctagaggcggataaccatttcctgttgtcggttctgggggcaattctggtcgttattgtcattctgctgtatgcttttcgctgcacgaagctggtgaagaagtcttctccgatcgatgcgatccgttccggtcagacgggggaacgttataagaaaaaatcgccgtttcgtctggtcaaaagccatggaagcaccggtttctttatggcggtcaatgatgtgttcagtgcaccaaggcggtatatgacgatcataatcacattctttttgtgtacgttgtttgtgctggtatttgtcaatacctcatcaaccatgcgaagcgatacgtttattacaacattcggaacgcggagtgatctgtattacaccgatctgacggaagcgatgagcagcatgaatccggatggcagaaagcagattgaggagtattttgcaaaaacggaagcgctgcttaagaaaaacggaatgcctgcgaagctttgtgtggaaacacagtacaaatataaggttcgattcaatgggaaagattattccatcaattgtcagcagggaatccatacgaaagcatccgcgtatgaatatatcaatggggtagttccgcaaaacaaaaatgagattgcgattacaccgacggtcagcaaattgaccggggcgaaactcggagataccgtaacgattgattttggaaaagagacacttgactgcgttgtggttgcttatttccaaagcatgaatcagcttggagaggtcatacgccttcacgaggatgcaccgaccgattttacctatattgcgaatgttatgagttatcagatcgattttgacgaccatccttctgcgaaggagatagagattcgaaaagaaaaaatcaaaaagctttttgacaatgaaaaagtaatgaatgccacggaatactgtgacgactgtatgggagcggcatcgacgatggaatcggtacagtatctgcttcttggaattacactgatcgtcgtgcttcttgtatgtattctgatggagcggtcatttcttgcggacgagaaaagccagatcgctgtgcttaaggcgatgggattcagtaacaaacgggtgatggaatggcatatgatacgattcggtattgttacgcttgtggctgttcttttggcggcgatctgttccattccggcaacgtatctgatcggtaatccgatattcggcatgatgggggccggaaaagtggcttatgtgatccgtccgtggaaaatctttttcctgtatccgggcattattttccttatgacgcttctggcatcgggaatgacagcattacagattcggacgatcaagagcaacgatacaaccaatatagagtaaacggaggaaaatcttatggcagcattgctttgtgcaaaagatctttgcaaaacctatgtaattgataaaaggcagaataatgtgttaaagaatgtaaatcttgaagtaaaagaaggggagatggttgcaatcatgggaccatccggctctggaaaatccacgcttttgtatgccatctcgggtatggaccgggcaacgagcggtcaggtgctttttgaagggaaggatctgacgaaactgagcgaaaaggaacttgcaaaaatccgattggatgagatgggattcatttttcagcagatgtatatgatgaaaaatcttaccattctcgacaacatcgtgcttccggcggcagaaagcaaaaagtccagggaaagcaggcaggaaaagcaggaaagaggcgagcagcttatgcgcaaaatggggatcatcgagattgcagataacgatatcaacgaggtttccggtggacagcttcagcgggcgtgtatctgcagaagcatgatgaaccgtcccaaactgctttttgccgatgaaccgaccggcgcattaaaccgtacttcctccaatgaggttatggacgaacttgtgaagttaaacaacgaggggacaacgatcgtcatggtaacgcatgatgcgaaagttgctgcaaaatgcggcagggtgctttttatcgtggacggcaatatcaagggagagtataccggtctcaaggagattaccgatggaaaagagagggagagaagtctgaataactggctgctggatctgggctggtagtcgggaaaggcgtttgaaacaatcggggacgataaatttatgtttcaggctattgcgcatgcgtaagtatgatttatatgatagtgtatatgaataaaaatgtgaaaaaacacattgattcatacgaaaagatgtaatataatacattaaaatataccaaaatattttggagaagaaggaagaagaaggagaatgcatacgcatgaaacgtaaaataacgtctaagttatatgagtggaaaaatatgtcagatggaagaatgccattgcttatttatggtgcacgtcaggttggaaaaacatttgaaatgcgtgagtttggatcattatattacaagaatacgatttatgtaaattttgaaacagacgaaagaattggaaaatattttgaaacagatattcatgcagatcatgtgatagctgttttggaaaaatactatcaggcaaagattgtacctgaaaatacactcataatttttgatgaaattcagatgtgtgaaagagcattaacttcgctaaaatatttttcagaagaagctccggaatatcatgtaatggctgccggaagcctgcttggtgtggcggtgaaccgggaaaaatattcatttccggttgggaaagttcagatgctgaccatgtatccaatggatttggaagaggtgttgtgggcaaaagggaaacagatgcttacagacacgatccgggaacattatgaaaataatcagccgttgaatgagatgctccatgaggaggctatgcaggaattttatcattattgtattgttgggggaatgccggcagcggtgaaagccgaccttgcaaaagacagtcctatagagcagacggaaatcagacagatgttattaaactcttatattgcggatatgacaaaatatgcgaataagtcagatacagtgcgcatttttgaagcatatgattcccttccggcgcagttggcaaaagacgctaaaaagttccagtataagttgataaaatcgggcgcgcgtgcatctcaatatggagatgcaattgactggctgattcgggctggaattgtaaataagtgtatgaaatgtagtcagggattttatccggttgcagcatatcaggatgtgagtgcatttaaattatactatagtgatatgggtattatgtctgccagaatgggaatgacgctggaagcattgaggagtaaggaaacagagcattttcgtggtatattgacagagaactacgttgcaattgcattgaaaacgaatggctatgatcttcattattgggagtcagataatacggcagaagtagatttcctgatacaaaaagacagtcatgtaattccggttgaatgtaaagcgggaaatcatgtgaaagcgaaaagtatgatggtttatatggaaaaatatgatccggtttatgccatcaggatttcaacaagaaattttggaatggtaaaggggataaagtctgtgccattatatagtgtattttgcacttgatatacgaggcttcactacaaatgaatcatttgaaaaacagtaccagttattactgggaaaaagatttattaaatgtttcactttcgtctatgtaaagtgtatattctgccaagcagacaccttctttcttctatagtatttaatctcttacctaaaccaaaagccaccttttacagtggctttttacaagtgaacgatattctaattttttatttccgtcatccccggaggataaacctacatgtgaataatattctaagcgtcattcacgcacttgcgtatacaacattaattaccatgtggtttggtcggtaaagtacaggcgaaactgtattcacgactatcttcataaagtgaccagagcagtagtgaattattgtaaagcaaatgatatccacacggttattattggcgatatcacaaatattcgaaggaataagaatctgggaaaagtgacaaatcaaaaacttcatgcaccacaagtaacaaaagaatatgcaaagaaatgtaacagaacgaacaggggattgtataaggtgttttatttaaaacagtctccaaaatttcttgaaatatcaaatgctttatgctatattgaatataaagaaagacacctgctggaacagatgcctttcagttcggatagtatccattccaaaagtggatgctcccaagtatgcattttgctcttatgagcacagccttacctgtttgccgacaggtaaggcatttttatttcttcttattatttctcttatcgagaaaggtaagaaacgcaataatcaaactaccaaaagacatcaacaaagctaatatcccaatgaaaatcgtaatgatttcataagctgtcatatgcgccacctcccttcttatgtattccagtaaactgtcattaagctcgggaggctaccacccctgtcatgggctttccgtaagaaaattgtatcataccaacataagggtttcaacaatattcgacagcgtgatttttcattttttccaaataaaaacacatattaatagtgaaacaaaagtgctctatcataaaaatgggaaacacatattaataataagaataaaaatcgaaggaggaaaaaatatgagaaacgatgatagttatgaagcctacaaaaggaaatttaatctgggggttgttggtgtaattatacttatgctggtgctttggtttgggaattttgatggttcgaaccacaattgggagctactggttaaaaatataggcaccaccaaagcaacttatcggtgtagtgattcttccatcactgatcttatcactgatcttttttgggacgaacataatcaggaaatgcttgaaaaatatgtgaaagaagaacgggaatgggaatctactcatgaatatgaccattttttggaagatttgggattatatagtgttatttgcctcgatggttgcattggttgcgccccatggcgcacctttggctgtaccactgtagtagatagtggttaaagaaaatgcgttttcaaataaatttgtgggtatatttgtaaggttatttgataatgttacactaataagattactacaagattcaaacacaccctgttctatataagttacgctattcggaacaactatggccgttaagctttcatttatctgattcgtccgcatgtgctgaggtaggggaaacaaccattccaacagcaagcgcccctgttaaaatttttgctactaacttttttaattggctattttggctgtataccagaaaaatagggtgttatattctttgggagcagaacaaagaaagatatcgacaggatggaacttcctgggattgtatatgtgatatgcaaaaagacgcatggtcaaaattttctttagactcattggtgacgaatagagataaaaaattttgtgatgcagatacgcttactgaagaaatgaaagaattattgatagagaagatattggtttatagcaataatgtattggaaatatactggaaagcagatttcataaaatacttttctgatacaagcaggatcattggaaaggagacaggaaagaatgagtgaaacagcaatcaaggcaccaaaggtgaatcattggatttttgtgttaaaagacggaaaatttgtatttgataaaaagacattggaagctattgacaaggtatatgcaatattagaggctgttgagccttgcggagaggataacagaagagagttgtggctgaaagcggagcgtggaactatagacgattatgacgactacgaaagcctaaaggatgaagaagtcgtagagaattatgaagagtttgagaaaatgtggcatgaagaatatccagacgaaataagctggtatcatcttgtgacaatagaacgggatgattacagggcaatatttcttggaagagagctgatctatcagtccaggattctggaagctcactcttcatatgagtacaatgttgaagaactatttgtatggatgcaggatgcagttaagaaatgtattgcttaaatgaaggaaggaacctataatgaggatgtgaatgataatctaaatgccagacagagaacaggtacaatatcaagaaaagattactgggatatattccctgaacgaaaagattcttatctgtcagacattacagccgctacgacatcggagaaaaggagcaggatattattgctcttgtcggagttggaaaaagcaaccgtgagattgcagacgaactgtttctgagtgagggaaccgtccgcaattatatcagcagcattctcgataagctttctctgcgtgaccgcacccagcttgcagtattctatttgacgaaggtgcgcaactagcaacgaaaatttaatcgaatcagaaaaccagtccttaaaggcagatggtagctgctcaaagggcacaagcgaaaatagtcatataaacaaaagaagggggaaagacgagtttatgccatttatgggtatagagcattggactattgtaatatgcgatgatgatgaaatatttctttcgaggttggagaaacaaataagggcagaattgcagcagctaaatgtagtgggggaaattgtatcatacacggatagtgagaaattgttggagacaaaactgcatcagacagaaattttttttcttgatattgatatgccggaagtaacgggtatggaattggctgccaagttggaagaacaaaatccgcaggcaattgttatttttatcagcaatcatgaggaggctgtatttgaggcaattcactataagccatttcgtttcattagaaaagcgtatttacaggcggaactttcggaagcgttgcaaagcttgaaaaaacagaaggagaagagagcgcgatttattacattagatgtaaaagagcaacagattgtgcttccggtaaaggaaatcgtttatatagagagtcaggctcattacctactatttcatgtaatgaattctgagcgtgaagaacaggttgtgcgaagcagaggaaaaatatctgattatgcagaaaaaatgcttattttccatttcctgcgtccgggaaaaagttatcttgtaaatagcatgtggatacagaattttaatttgaaggaaatcactgtaaaaacagggcagcatattccggtcagtagagataagaaggaagaggtaaagaaacaatattttggttatatgaggagtcggatatatgaaatggattagtttcataatagagattgcggcctgcattatcagttttggaatttgcacagcggtaattcgggcgcaatttagacctagagacgaattggcatggtggaagtatcttgtgtttggaatcacatttacagcagttacttattttgaagtggggtcgaatctgattgcgtcatttattggaatgggaatatgtattttttttgcccagagatattttgaaggacggtttgcttcaaaagtcatctctgttattatgattaatgtattgacaattctgataagtatcatatgtctttatgttatttcagcattcagcggagtgacaatggaaaaactgacgatgtatgggaattcgatgagacttatcgaggtttgtgtcatgaagagtctctgcatttttatcgcatatgcttatataagaactataaaaagacagagagaatttgtacaacaggaattgctgataagcgggattttttttgcttgtttttttgttgtctctctgttttttattatcctgttaaaacaggttatgttaccgcgaatcttacagatagcttttgcagtaataacgcttttgtttctgggaatcattcttcttgtgttgtggctcttgaaccacttgcaaaatcaaaatcgagaactgcttgagaacagtattttgcgaactcagttgagggagcaggagaaactgatgaaagtatcagaggaaagcaaccaaaaaatccgcgaagtaagacatgatatccgacgttatttctcgaactatctccaacttttggaagaaggtaaggtagaattagttaaaaaagaaatgcaaaagacttttgccacgaaactgtcagagaaacagcagatttatacccctaatttgatgttgaatgctgttatcaatgagaagaaggagatatgtgaaaagaaccacatacgatttgtgattcatgtgaagcttccggagaatatagatacgatagaactggcaattgctttgtcgaatcttttggataacgcgattgaagctgagcagaaagagcaggagcaggaaattcatcttaacatggaagtggtagatgaaatgtttaatctaattgtagagaatcacattcaaaactctgttctttgtgtaaatcctaaacttgtcacatcgaaaaaaaataaggctgaacatggattgggaatcccgacagttcgggagattgtcaatcagtatcagggatttttaaatatatcggaagaagcaaataatgtgattgtacatatggtaattccacttgctaattttgccaaaaacaggtaaaacttgccaaacgaattgtaaagattaagaaatcagttatcatcagattgaaaggacgtgtgtttatgtctggattatcaaaaatgatagctgatttttttgttcgtgaaaatgtaattgaacatgaggaatatgagatttataaatatggttcagatatattaattgaaaatataggtacaactatatttttgatttgtctgggttttattttcaataaagaaatcagtacactcatttttattgctgtatttgccggtataagacgatattcgggtggttatcatgctaagacaaaattaaaatgttatattttgactatcacaaattgggcagttgtaatagtgttacagaggctgcaacaaaaatttgggttcactagatttggaattgaacttattatatgttgcatggttttcatggttatgttcttttttgcaccagtagagaatccaggaaagccattgtttgaacgggttagaattgtaaataaaagaaagacacttatcataacattgatggttatcattatatcgttaagcataaggataaaattgccggacgcatcatttgctattctggtagttttaatagaagtagcgctactaattatatgggggaaggaggatgtcagatgaaaggtaagaaatttgcagaggtatttgcgtcacttgtaaaaacagtggcaattgcatccgtatctgaaagctcagattggtataattatcagactaaggagccggaaggactgaggaaaatctatttgataaaacatgaaaagaagtaaagaatgaaattggtaaaaatttttgtggaaaaacgtactttacaggaggaaataacaatgaaaaacaaattaaaaaaagcactttgcttagggttagtgttaaccatgttttcaacaacaagcgttatggcagcaacctatggatattcatttggtctcatgccggaaaatgttcaaaatacagcctataaagcaaaaactggaagtacagcctatgcatctgtgcatgttacggaaatgaattatccgtctgcctcaattaagtaccgtacacatgtagcagataagggatttacagcggagtatactgaacaaagaggcttaggaacgtgtacagttatttacaataaaacggtaaaaaaagatgaaaatgtaagtttatatggttataatccttcatcaaacggtggaattacggtttcagtaggaggaacttgggaaccataagaagttatgataagcagatgcggcatttggcgcatctgcttattggagggggaaagaaagatgggaagaaaaaattgtgcagttattatgctgacaagtgcctgtcttgttctgacagcctgtgcgccaacggagtttcccgagcagaatggcacagagcaccagaatcagatggagggggtcgccaaacaggagcttacagagtttgatacagatgatgttgagaaaattccagatcatctgacctgtcaggtggatgatctgttaatggtagatgcagatgtccggttatgggggctttcggaatggaagctttccgactggtatgcgacagaaaaaaattatacagaatcagaagaagaggcacatgagctgattcagaaaatgatgaacgaagcagggtggaaatatgaggagaaggatgtagagtgttacaggaacagtgaaggggaaaaaatttattatgtagagatttcaaatcatgaggacaatgtttatgttttaccggacagatttagttattcaactgaacgcgggtatgtttccttaaatcagtcagacttctgcggagattataagggagacaacagagaactgtacaaaaccggcagagagctggcgttcggttcgataaaagagagtgaacagctggcagtggattatgcagaaaaaatgggaattcaggtcagtgatacagtggactgctatacactggatgaaaagaataagagaatatcatggctggatcttgataaattcgacaatcacacaccggaggaagaagaaaataggaatttctcgtatgcgatatttctttatcaggattactttggcattccgggtcttagatatgatccgggggatggaaaacttacaaacgataccactttccgttcaagcgtgtgtgaagtaagtgtagacagggatggaattgcatattttcagtctgcaccaacgtatgagctggagaaaatgggaaccgaacaggagattcttcgtccggcggacattatagaaaaacaggtagagatgatgaagtcaaaggaggaaaccggtgaaatgaagctgtcggaggtttcgctggaatatctgccggtttacgataaagaaacggaattgtaccatatgtgtccggtatgggcatgttattattcgcagacagtcactcactatggtgaggtgaattatgattccgaagagaaatatatagctatttatgatgcctatacaggtgaagttctgcagaccaaatgaggggggagaaatatgaaccggtattttacaacaaatgtacttcgcatgtttcagaatcgaaaaatatatatctgcacacttggaatggcactgacactgtatatgagcggaattgcttttatccgctcagacggggattctgcgaatctgcaggatgctttttccgtcgtatccagttccgggttcattatcctgttttatctgctctgcgtgattggcggaggtctcagttactgtgaggactgtaacagtggttttaccagatacgcagtcgtaagaggtgatgcaaaaaagtatatcagggggcatcttttttctgcagcccttggcggctgtgcaagcatgcttggcggtatggcattgtatgaactgctcatgatttttacgctttggccgataaaaggctcgttttatgctatgttttcgcagaatcatgcttactttatccagaatatctggaatgctctgctactgtccctgctgggtgcggttctcgcaggattggcgatgacggtgacggcatgtattcccaatatatttgtcgggacggcaatgcccattcttatttattacatggtcatctgcctgtccaataaatatgctccgctggagctgggaccaattctgccggcatgggtatactttggcaatgcggaatttctggggggaggaatctggcagatgctttatgctctggcgtatacaggctgtatctactttgttttgtggaagattgcggcaaggcagattataaggaggatggaaaatgcttaggagtatgtgtaacaatttcagaaagtggaaaagcagctaccgggtattcatcgtctttttgtccgttttggttttcacatttatccgggaagattatttaaggcagtatgcgcaggatgtgggactagcggtgacaccatattttttcgcttttcagatggatgacggaataacgcggatgcttttttattttggggtggttttattgttttgtaatgccccgtttatggatgaccagcagatgtttgttctggtgaggacagggcggctgcgctggtttgccggacagcttgcctacattgttgccgcgaatctggtatattttctgtggactgcactgacgacagttctggtactcattccgcaggtcggattttctacggactggggcggtattatccggatgtgtgcagaaaataacggactggccggagtggtgatgcacaaggaaatcgtggaagcctatacgccacttgctgcctgtctgattacctacggactgaatgtacttgtgggtacgctgcttggtcttgttgtttttcttggaaacatgcttgggagcagaatatatggatcagcagtggccattggctggattgttttttccaatatgattgatgtggtgaggctgcctaagctcagagttctgtcaccactgcactggacgaccacctatgcttatttaaggagcgatgatgcagttccgctgtggtatattcttgcggttgaaatcgcaattattctagtgaccggatttatcattatgaaaaaatcgaagacatacacacttgacgctattgagtcaggcttttagaccatttgctgaaggcagaaaggatttagagaatggaaaatttgatagaaatacaggatgtcgtaaaaaggttcggggaacagacggttctggaccatgtgagcctttctgtcacacccggaaaaatatatggaatcatcggaaggaacggaagcggcaagacagttctttttaaaagcatctgtggttttgtcctgccggatgcggggaaaatcctggttcgtggcaaacaggtggggaaggatgtggatatcccacagggaattggaattattattgaacatccgggttttctgcgggattattcaggctttcagaacctgaagcttcttgcgcgtctgcagaagaaaatctcagatgagaagataaaagagagcatccgtctcgtggggcttgatccggaagataagaagaaggtgggaaaattttccctcggcatgcgtcagcgacttggaattgcacaggcaattatggagaatccggacatcctcattttggatgagccgatgaacggtctggataaacatggcgtggaggatatgcggaagcttctggttcaattaaaagaagaagggacaaccatcctcgtagcgagtcataatccactggatatagaaattctctgtgatgaggtgtacgagatggatgccggagcaataacgaaagttcattaaaacaaaaaaaccaagcagggaattattatataatgcttattgactgtgcaatcatacaagaatatattcctgtctttgacagttattagaagaaaaaatcgctgtatccattgattttactggggttcagcgatttttgccgttgttttgaagtatagtaatttattccttccctttgcagatataaaaggactctgcatttttggattttgatatatgaagatgcatatgcaacaccttcttattatacaatacaataacagaaaataacatatataaaaacataaaatttgacgcaaaaaaagcaggttttataaggcctgcaagtactttttctattattcaactgtcaaactcccgagtaggcggtgatagtgatgcgctgttgacaaaatgtagtttacaacataaaataaatatgaattaaatataacacttatcgttgccaccgggcagcgattaaatgaaaggtgttcaggacaccgccgtaggtacagcgcattaaaaatgtgctataaggcgatgccttggatacttttttctttttggtggcaattgggaaagaaaggagattttatagtgaagataagaataaattcttagaagatttttgtaaacaaagattaacttatggtaacattgagggaaatcctgaatttaaagcaggagtctgcaagctttataaaactattaaattggatgagattatccccacgcatggtgctacgggtgccaatcatcatgtgttttattctctcatttcgccgggagagagagtcattagcatcagaccgacctatcaacaattgtattctattccggaatcctatggtgcagatgtgcagttgattgatcttaaaaaggaaaatgggtatcttcctgatattgaggagattcgccgtctggcaacaccggaaacaaaaatgatctgcccattgattcttatacgttttgtgaagaaatgtacaagcagacaggtgcttttgtcacgccaggggactgttttgaacagtcgcacagcatgaggattggatatgcctgtgatgccgaaatcctgaaagctggtctatgtgcggtcagcgaatatattaagatgaaattgaaagtgaattaaaaaatcatgtgatttatccgatatatgaaatataagggaaacaatggatatatttcacggaggagacattatgaaagtaggagaggcaagaggaatctacagttctgttctgaaatcatacaatcagcagaaattcaaactgtcaaagcagcgaaatgagctaaaggaacggatggaaagcacaccggacggtaaaacgttgtatgccgatgaggcagccactctggatttgcaatataatgccgttgcagaaaaacaggatgaatatcaggattatgtagatcagcttatggagcagtgggaaagcaagtttaacagtgttgcggcaaagcagcaggacgaggctgcgaaagactacagtgaggaaatgggaaaaatcatgacggtagccagacgcatcatgcatggagacattgtgccagcacaggatgagaaaaagctgatggaatttgataaggatctgtacatgatggcaaaaaatgccggaatgatggcgcggttggaaaaacgcaaaaagtataagtcgctttgggatgatgaggaaaagaaagagcgtgaggatccaatggaagcagctgatgcagaggaagcatttgcagccggaccggaggttgtgtcggtggaatcggttatggaggcagcgactggggagatggagtcggaataagagtaaatggactttcaagttggtaaaaattgtgctaaaataacagttagaaataactaacctgaaaggagagacgtaactatggtaatcaggattacagtagaagcaatcgtgtacagtctgctttatacagcgtttatgctcgttttatttagaatccagggagcaaaataccagctttacaattatccacctgcaattaaggcgcgggctattgaaaaagggattacaacacaggcggagttggatgcacatgcgaaaaagaatagagtattcgggcttttcgtgtaagtgagtatggaaatagcatcctatgtattttttacaagaaagtttagtttgactttttagaaaaagagaaatataatgattttcaaacgagtagcaaacgagcgtaaatccagttttgctgctcgtttttatttttatgatgccatgaaaaagtgtgtagcttatcagcgtaagtccagcttgtgggataagtacatgctttttttatgcagaaaaaggaggattcagttaagatggcagaaagtaacaggatgaaggagatgccggtcaataagctcatggtgcagatgggaataccgatgatcttgtcaatggcattacaggcggtctacaatattgtggacagtgcctttgtcggaaacatgaaggagggaagcgaagccgcattaaatgcacttacgctggtatttccggtgcagatgctcatggttgcagtaggaatcggaaccggtgtggggacgaatgcacttcttgcgaggacacttggacagggaaacagcaaaaaagcagcaaaagttgcgggaaacagtttatttcttggagtaattatttatgcggtatgtctgctgtttggaattttcggagtgaaagcctatatttcatcgcagacggttgatccggaagtaattgcaatgggaacaggttatcttcgaatatgctgcgtgatttcgtttggaattatcttcttttccctgtttgaaaagttattacaggcaaccgggcgttcactttattctacaatcggtcaggttgtgggggcagtagtaaatattattcttgatccaattatgatttatggtattggacctgttcctgaaatgggagtagaaggtgctgcgtatgcgacggtaatcggacaggtagcatcggcagtattactctttattttccatatgaaattaaataaagagtttgcgcatggaacaaaatacatgaaaccggagggcgggataataaaagaaatttattcgatcggacttccggcgatcattgcacaggcattgatgtcgatcatggtatatgtgatgaacctgatcctaaagttcagcccgtcggcacagactgcatatggattgttttataaagtgcagcagtttgtgttgttccttgcatttggtctgcgtgatgcgatcacaccgatcatcgctttttcttatggaatgggaagcaaaaagcgtatcaaggatggaatcaaatacgggctgatttatacgattgcacttatgatcctcggtgtgctgatcacggaaattttcccgggtgcatttgcaactttatttaacgcagggctgtcaagagaatattttatcggagcaatgcacattatttctatcagctttctttttgcaggagtcaatgtcgcatatcagggaatttatcaggcattggacggaggcatcgagtcgcttgtgatttcgctgctcagacagcttgtaattatattaccgttggcaggcattttctctattttcgtccgaaatggacagatgggagtttcgctgatctggtgggcgttcccgatcacagagtttatcgcgtgtctggccggctatgtatttttaaagagaatatggtgtatgaagcgcagaggaaagtgattttggagattgcggaaaaggaaagctgtgtgatcataggacggaatgcggattttatcttaaaagacaaagataatgtgctgaatgtttttatacatggggatatgccggaaaaggtagcgcgtatctgtaaactgtacaatgttaccgaggaggaagcagaaaaaatgatggcggatattgataaaaggcgtatgacaaattatcgattttatacggatcagaagtggggtatggcaaagaattacatataaatatgattacattgcttttgcaacgattttctcatcgttgttttgaatctcgttgctgcttttttctttcttacaattgttacaacaaaagagaaatttgaacaaagaaatggtgccgagaaaaatgctgtttattgtattggacagacatctgtaagtcagtatgctaatctttgtagtgtaccattaaattctattttaaggagaaactatgtatgggattaacagatacaagtaaatttttaagtctggtactcagatataaaccggatacaataggaatttcgctggatgaacacggctgggcgaatgtatcagagttaatagaaagcatttcaaagacaaggccgtttgacatggaaatgctcgaaaaaattgtacaaacagataataaacaaagatattcatttaatgaagataagacgttcataagggcaaaccagggacattccatacccgtagatgttgaattaaaaaaagccataccgccggagtttctttatcatggaaccggggagaagtatgttgcatcgattgataagaccggtctgattccaaagagtcggttatatgtccatttatcaggggatgaagatacggcagtcaaggttggaagcaggcatggaaagccggtgatttacaaagtggctgctggaaagatggaaagggcaggttatgcgtttttcttatcggtaaacggagtctggcttacaaaagaggtgccgaaagagtatttgattaaaatggaataagagtaattccgattgaccattttgagtgtctccttgcttaggctttattgttgcgtgcaaattgtatttctgtgttaatgtcatttaaggataaatcctgcagattgttttgttctgcggaatgacgcagggcattaaaagcagagcgtccgtcctctaaagaaacgctggtggatgcacaaatttcaaatggaattttacgttctctgacaactgcccgcgcaaaaatattaaatgcggtggaagcgttcataccaaattctttacataaattatcaaattgattttttaaagaccatatggagcgctggtcgatttttgtaaaaagtgcaggtagaaacagttaagcaaagatgttatcatttaaaatatcaaagtgaaatatgtggaggaactatattggttagagaaatttatgaaaatgaattaaaggatctgcttgaattatatttgcatttgcatgaaagtacaatctcggaaatgtcagagtatttaagtaaaacatggaattgtgtattttcgacagcaggacacgcaatagacagcgaacagagagggcaggggctggaaattgctttgccaatcacagtaggagacaatgtctggattggaacgaatgtattcgtgctgccgggcgtgacaatcggaaacaataccatcattggtgccggaagtgttgtgaataaaaatattccggatggtgtgatcgcggccggtaatccctgtaaggtaatccgtaaaataaccgaatccgataagaaaaaatatccaatttttgaggaaaatcatgaacattttaatcatagaagatgatgcagccatccgtcaggaattaaagctgctgttagaaaatgcactgtatcaggtcacggtactgacagaatttcatcacgtggtagaggacattctgcaaatggagccggatctgattctgattgatgtaaatctgccgcagcaatccggatttgagatctgtaaaagtgtcaggaaaacgtcggatgttccgattattttcctgaccagcaggacggattcaatggatgaattaagcggaatgctgcaaggcggtgatgattatatcacaaagccgtttcagccgccgttacttctggcgcatatcgcggccgtattaaaacgggcgaaaaaagcagacgtaacagagaagatgatctgtaaaggtgtggaacttgatgttgtccgtggctgtgtgaagtgtcaggagcagcaggtggatctgtcgaaaaatgaattgaaaatcctgcattacctgtttttgcatcagggagagatcgtgccaagaatcgaactggtggaatacctgtgggatcagcaggtctttattgatgataatgccctcagtgtaaatatcacacgcctgcgcgcaaaacttgcagaaattggtgtatgcgactttattgagacaaaaagagggatgggctatcgcatatgaaactgacagaatatctgaaagacaaagtgttgttgctgcttttacatatggtatgtatggcagggcttgttatctttttgcggctgaccggctattccatggataaatgtgtgattatactggtgtgttacggtgtaatactggcaggatggcttttccttcagtttttttcacgcagaagctatttcagaaaattagagcagcttacggatcagctggacaggcgttatcttcttggagaactgatgccggaatcgtttgggctggaagatcgcaagtaccgggaactgatccgcaaatccaacaaatcggtaatcgagcggatacaccagatggaacaaaaccaaaaggattaccgggagtacattgaaagctgggtgcatgagatcaaggcaccgatcacggcgatcgcgttaaactgtgaaaataaccgggatgagaggagccgctatctccttgtggaaaaccgcaaggttgagaattatgtggatatggcactgtactatgcgcgtatggatgcggtatacaaagactacatgatcgcggaatccaatctgcaggaagtggcacaacaggtgcttttgcagaacaaatattatctgatccagagccatgtaaaggcggaagttgcctgccccgatacggtatacagcgataagaaatggatcgcttttattttaaaccagcttattcaaaacagcgtaaaatacggaagaagtgagggtactcacattcagattgttactaaaaaaacaaaaagaggtgttcttttgagggtaaaagatgacggtatcgggattccaaaggaagaaattccacggatttttgaaaaagggtttacgggaacgaacggaagaaaccgggagcgttcgaccggaatgggactgtatctgtgccgtaaactctgtgacaagttaaatatagaaatccgggcagaatctgcggaaggaaagggaacagagatcatacttatgtttccggtgagtgattatcttaccggttacagggagacataacacgtttatctttcaaaactgtaagattcaggaaaggtaactccatacaaagcggacagatcacgtgttaaagtaggcatagtgaagaaaaaatgatattctttactatgccttttatttacaagcgagggaaaggagcgtcagaagatgcaggaaatcatacgcgtaagcgatgtggagaaatattatggaaacggggatcaggtgaccaaagcggtggatcgtgtcagttttgccgtgcagcagggggagtttatcggtgtgatgggagcttccggttccggaaaaacaacgcttttaaatctgttgtcaaccattgaccgggtgacagcgggacatatttattacggagataccgatatcacagaactgggggaagaacagctttcggaattccgtaaaaaacagcttgggtttatctttcaggaatacaatctgctggatacgctcacgctggaagaaaatatcatgctcgttatgacgctgcaccggcgtggcaaaaaggagattcagaaacggtgcagggagctgcttcgcattctgggaatcgaggaggttaaggataagtatccgtatcaggtgtccggcggacaaaagcagcggtgtgcatgtgcccgtgcacttgcaaattatcccacacttcttctggcagatgagccgacgggggcactggattcactggcagcgcagacactgttagagacatttacggagatgaacaaaaacatgggggcaaccattctgatggtgacacacgatgctttttccgcaagttattgcagccgtattctgtttctgaaagacggacggatttttcatgaactggtgcgtggggaaaaagaacgccgggcgtttttaaatgaaatactcgatgtgatgacactgacgggaggtgaacgttcccatgatgtgtaaacttgcttttcgaaatgtaaagcgcatggcaaaagactatatagtgtattttatgacgatggcggtcgtgaccgcactcatgttttcgtttcatacgcttttgttttccaaagatgtgcagaatctgtttcagatggatgccatgatgagtgtgatgacgggacttgcgactgcttttatcgtgccgatcattgcgtggctgatcaattatatggtgcggtttgtactggaaaagcgaagccgtgagtttgggatttatcttctggtcggggtaaagaaaaaagagattgcgagactttattttgcagagaatctgctgcttggagcgggcgcatttcttgtagggatgggactgggcctgctttttcagcagatccttctgtccattttttacagcatggtgcagctggattacaaactgcatctggaatggaaccgaaactgtattttgatgacggctgcatgttatctgtgctgttatctgctggcgctgtttcgtagccaaaaaaaattccgcaaaatgaatatccatgatctgatggacagccagagacagaatgaggaaatcaaagaaacacatgaaaaggcaaagagatggttccttccgttatctgtgctgtttcttgtcgtattcggtgtgtttctgttttgttttaaagcatgggataccggagttgtaatcgcttttctcattggactggtgctgacgatttatcttttttacacaggcattgcggcgtggatcgcctgttatgtcagaaaaaagggagctgctatttaccgtggggatgcgctgtttctgctccggcagttttcttctaagatccggacactgcggtttaccatgggaacactgacggcactgtttactctggcgatactcggaagttcggtggcatttatgtttaatcatttccagaatgaggtgcttgtgagcaaatttccgtttgatgtgcaggtatacagcagcaatgtgaaggatgagtttcagcaggaaattgctctgctgaaacaggagacagccataaaggaaatttttacttataaggtttatgagaacgaaacgaatcaggtcaatgcatatctgtatacacatctgaaagaatttggatcagagtatcggaacgcagatggcacaccggactggaaaaagatcagtaaaaatgaagaactggcatattgcaattacgatacctatatgggactctcggattacaaccggctccgtaccatgatcggactttcggaagtgcagttaaaagaagatcagtatgccatccatatcaaagaccgcgtgctgaatcagaccggggatttttccggtcggatcaaaattcagggaacagatgggacattatcttttgcgggctatcacacggagggattttcgcagaacggccacaacggaggggattatattattattgttccggatgccgttcttgcacagatgcatccctattatgcagaattggtggcggatatcaaaggcgaggcacctgcggatttggagaaacggctggatgatctggagaaggatccggataaaattagtgtgcaggggcacgccatgacggaagcagcttcggatgactgggatggggaagcacttggaaattcctgttcgggttcggatacaattgttacctatacggcaaaaaatcttgtgcgtgacaatctgattccggaagtgaaatatatgttatcttcgctgatgtttccgcttttttatatcggactggtatttttgtgtgtggcactgaccgtgctttccgtgcagcagctcagcgattccgtaaaatacaaattccgctacagggttctctttcagattggttacagcagaagagaaatccgcaggatgattttaaagcagcttgccggttattatctttgtccggcatgtgtgtcacttgcaatcagcggactggtctgtgtatatgttggtggtaagtttgacttttatacgggggttcgggcggcaccggcaacttattttttgatttcttcggtattgtttttcggaatttatctggtgtattttatcattacctatattggattctgccggaatgtggaagagtgggggtaagaaagggatggggagaaaatgaagaaaaagaatcgtgcgttttatcattatttcattccggtcatatatgctgtctttgtatatatcctgtgggaactgaccggaacattggtggcttatgtggttggaaaggtaatggacaactgggaggaaactttatacagttcttatatttccatgttattcaatgaagtgttgacgtttgttattatgtttgtattgtttcgcaaaaaagcagatttcgtaagaaaagaaaaaagaaatgggtcatggttaccggtattgggaatgtttatttttccgttaatacagattgggaatgatcttatgactctcgttcatggaaaaaaagttttttcactgctttccggtaaagggatttgttttttcctgatctgcggtgtggcaagtcttagtattggactgctggaagaatatgtgtggcggggaattctgttaaatatgtttcttgctgcatggggaaaaaagaaaaatggaatttattgtgcggtagttgtgtcttcccttggatttggtctgtgccattaccggaatctgctggtgggacagaactttgcagatacgacaaaacaggtattgtatgcgatttgttttggcatgtttctggcagcactttttatacagacgaatcatttattcattccggttcttgtacatggactttgtaatttttctaatttttttatgaatgaaattcttggatggaattataccgtttggaaatatgatgatattttgcagggagtattagccgttttttatttgagcgcaggcctctatgtggtttacaggagcgtgcagaaaaagcagaacataaggaggaaaacagaaaaatgagtaccaaaaaagtaattggcggttcggttgctgccatagttattctcatcattgcacaacttacagcacagcttgccgcaagtgcattgaacctgataaagattccggatggaatatgtaatatcattgcaggaattttttatgtcggactgacttatgttattttaaagatatatattgagaaagtgatcaggttacctatttctgattttggaatgcccgtatttcatattaaaagaaaatggattctaattgctattctgttgccactgctggtaaaaggaagttatcttttgttctttcagggtgcgtatgtttcctcgcatatgaatggaaagcagatatttcgtacattaagtgccggaattatgtttaccggaatcgcggctggatttgtcgaagaaatggtatttcggggcgttattttaaatcttttaaggaaaaaatggaatcgtaaggtggcggttatcgttccatcggtgctgtttggcatggttcatattctgggaatggatttttccatcggaagctgtttgcaggttcttgttgcaggaacgatggcgggaattatgttttcaatgattgcaatcgagagtggttctgtctggaacagtggaatcgtgcatgccatctggaatattgtaatgatcggtgggggactggcaattggacaaaaagcggatcaattctctgtcatgacttatgttcttgatgcaaaatcatttgcggtgacgggcggtgaatttggcatggaagcgtctgttatttcgctggtggggtacatcatagttactggtgtggcttttttcgggaataaagaattatgtgatatcatttacaaaaaagaatagttgaggtatatatgtataagacagtaaaaagatggatgcagggaatggccggttccgggtgcttcaacattcttctggaagggaaagccccttgcttatatgccgtttgtgtatgaacatggaacgcattttgtactgccggaatctttgcttcgtatggctttgccggtaggacttaaatttgtgctgcactttatattcagagcggcaaaagaataccctgatgcgtgtgaagcaaccagaatagatattgacagaaagctttctgctgcactaaaagaatggcgggaagagtagaatataaataaagaatcgcgtgaatagtccgatatatgaaatgtaaggaaacaatggatggatgcatttcacggaggaaatattatgaaaacaggagaggcaaggggaatttacagttctgttctgaaatcatataacgagcagaaattcaaactgtcgaagcagcgggaagagttaaaggagcggatggaaagtacgccggatggaaaaacacggtatgcggatgaagctgctacactggaactgaaatataatgcggttgcggagaaacaggacgagtatcagaattatgtaaatcagcttatggcgcaatgggaaggtaagtttaacagtgttgtggcaaagcagcagggcgaggccgcaaaagattatggggaggaaatgggaaagatcatgaccgtggcaagacgcctgatgcatggagatcaggtgccgatgcaggatgagaagaaactgatggaatatgataaggatctctatattatggcgaaaaacgccggaatgatggcgcagttggaaaaacgcaaaaagtatgattcgctctgggaagatgaggaaaagaaagagcatgaggacccgatggaagcagccgatgcagaggaagcatttacagccggaccggaagtggtgtcggtggaatctgtcatggaggcagcggctggggaaacggagtcagagtcataggatggtttaaaaactatagataaacaaaaaggattcatccgtctggatgaatcctttttcgatgcaggagatgggacttgaacccacacgatattgctaccacaggcacctgaagcctgcgcgtctgccaattccgccactcctgcgaacaaatgctattctataggaatctgagcaatatgtcaatagataattttaattttttttattttgttgcaataaaagaaaaaatttaaaaaaattaaaaattaccattgacatatgagggagagtttgctattataaacgagtcgctaagacatgcggaagtgtcggaactggcagacgagcaagactaaggatcttgtgatcattgcgatcgtgtgggttcaagtcccatcttccgcactaagatgtgagaaagccttgagagatcaaggcttttttgttatataaaatatggtataatgaagcatgctgatgcatgcgcaggtcatcaggctccgcctggtgacaatgtataacgaagcatgctgatgcacacaacaaaaaggataactatataaatatgaatattcaaaaacagtttataaaatatgtttctcagaatatctgtggaatgttggggatttcctgctatattatcgtggatacattctttatctcgcaggcagcgggaacggacgggattaccgtattgaatctggtgctgccggtatataacctgatttttgccataggatcgatgattggggtaggatcggcaacccggtatacgatattaaaagcacaggaagatgacagtgcaaagaaatattttgcaaatgcgattttgtgtatcctcataatcagcattccatttgtcctgtctggcattttttctccggatacggtgatgcatatgatgggggcggatgccgggatcacgcagctgggccgcacatatacgaggattttcttattatttacaccgttttttatgatgaattatgtgttttctgcgtttgtccgcaacgacaatgctccgaccctcgccatgattggaacgatgatgggaagtttttccaatgttgtccttgactatgtgtttatgtttccaatggggatgggactggcaggagcagcacttgccacagcagcctctccgatcgtcagcatattaatctgcagtattcatttttttcagaagaaaaatacaatacagtttgcaaagaccagaccatcggtacggatgcttacagcatcctgccagctgggggtgccggcatttgtgggagaattttcttccggagtgacaacaacgctttttaattacctgattttagggcttgccggaaatgtaggagtggctgcctatggcgtgattgccaactttgcactcatatttacctgtatttttaacgggatttcccaaggagcccagccactggtcagccgttattacggagaagggaatgaacgtgcggttaaaaagattctgcatctgggactggctacgggcgttgttttcagtcttttgattatttcgcttgtctggggatttacagacccgatggtagccttgtttaacagtgaacattcggtaaagatggcggaatatgcatttacaggaatgcggctttatgtgactggatttttgtttgccggtttcaatattatcggaaccggatatctgagtgcatcggagcatgcaaaagaggcatttacggcctcggtttgcagaggatttgtagctatcgcggtgtgttccgtgatattgtcacgtatatttggaatccgtggtgtctggctgtcgtttatggctgcggaagcactgacggcaggaattacggcatgggcgcttcttaaggatcacaaaaaggaggctatggcatgaagtatgataagaaagaacctgaaacgatggatgcagatccgatgcgtcttttggtttccgccatactggcatttacggtgatgctttttatcaatgggtttgtcggaagtatgggtggatttcctgcgtttgttgcatttacgctggtatttttccggatacggacccgtgcgggaatgggaaacggagggatgcagcaggaattgtcagatcgtcagatcacaggacggctgttgtggaaatatgctgttggttatctggttttatggggaattttaagaattgcgtttctgatctcccgggtcaccggctggggaaatatcaatggagcttccgcagtggaatatgtacggcagatgtggaacacatcgcttttggaaaaatgggcatatttttttgcggggatgatcatgtttgcgtttgtgctttcactgtttccgcttgctgtaatccgggaaaaggtgcggtggattcgctatgcactggttgatggtgcggtgtttgcattggtatgtcttggaattaacggcgtctgtcgtttgaaatttgaacagaaatcatcaggcagagcaacatgtctgatcgatcatctgctgctttgcggccggatgcggacctggcaggaaatcacctgtctgttggcaatggttgtttttattcttgtcatcggtgcatttgtatttagctatgcatccagacagtatgcggttaaaaatatagatggaataccggcatccgccggggaagaagaatcgcgcagacaccggatgatcagaaagattgtgacggttggctgcagtattgcggctgctgcaattgttgtcgtgatagtacttctgatgccaaaagataccgcaggggattatacgaaggttgcggaatttctgactgaggatacgcggatgggaccgatggaatatggagatgcggtttatgtaccggtaaatgaggaagcggatctggagaaaaacggaattgcccagggctatctggcagagcgtggagagcgctgcgacagtcggttttatcagcttgcgattgcaaatcttctgtataccgatccgaccggaaaaacaaatctcgtacagacagccggaaccgatggaggaacatatgcaccggtggcatcggtggaaacagacaaggcatgggaaacggatgatgtgtttcttctctgggatgaagactgggctttggaatcggcatattcgcatgagccgacaggttatgtggcatgtccggcggatctgatacagggactcaggatgcagtttccggatgtgacctaccgcacagcggatttttcggattatgatgcctattttacacttcggggatatcaggagatggagcaggcactggaggaagatcctgtggatggagactgggtcggatgtattctggtgaaagataacaaattttattttggaagctacgaaaatcagattacgggtatctgtctgcaacagctgcggaaagtactcggaggaaatgcaaaataaaaaaggaaatcaggaattcacgcagaatatataatatgtagagttgtttgaaatattgtaaggattttggcggtttgtgccgcagaaatgagcagaatatgacaattcgggaaagaatagaacagatagaagcagatactttaagtccgtacgcctgtctgtccataaattcaaagggcagagacagggaggaaccgcagtgtgatattcgtccggtctttcagagggaccgtgaccgtatcctgcacagtaagtctttccggagactgaaaagtaagacgcaggtttttctcacaccgatgggagatcattaccggacgcggctgacacatacgcttgaagtatcgcagaatgcgagaaccattgcgaaggcgctccggctgaatgaagatctggttgaggcgatagcactggggcatgatttggggcatacaccgtttggacatgcaggagaatttctgctgaatcaggtgtatgaaggcgggttccgccacaacgaacagagcgtacgtattgtagaaaaactggaaaaagacggagaaggactgaatctgacctgggaggtccgggatggaattttaaaccatcagacacggacgattccgcacacgctggaaggaaagattgtgcgcctgtccgataagattgcatatgtcaattccgatattgacgatgcgatccgtgcaatgattctggatgaggaagatattcccgtggaactgcgtcgtacgctgggatttaccacgagagagcgcctggatcacctgatccacgatatcatcagcaacagtatgggaagaaacgatatcattatgtcggatgagaccgcggaggcgctgcgggatctgcgcttgttcatgtttgaacatgtataccggaatccggtcgcaaaaggcgaggaagtaaaagctaaggccatgctggaacagatgtattatttttatatggaccatatcgagcagctgccggcaaagttattaaaaatgctggatgagggtgaagacaaagggcgcatcgtctgtgactatatttccggtatgacagataagtatgcgattaccaaatttaaagaaaattttatgccgcaggcatggaaagtggatggatattgatgactagagaaaggaggggatttccacgccgtatttttcagatgatctgattgaggaggtacgttcccgcaatgacattgtggatgtgatcggcgggtatgtgcgtctgcagaaaaaaggaagtacatattttgggttatgcccctttcataatgagaagacgggatcattttccgtttctccgaataaacagatgtattactgctttggatgtggagcgggaggcaatgtttttacatttctgatgcagtatgagaattatacttttaccgaagcgatgcaggtacttgccgatcgtgcgggaattgaacttcccaagcaggagatgacaggtgcacagaaacgtgaggcggacaagcgcacgaagctgctggagattaacaaagaagccgcaaagtatttttataaacttctgcgcagcccgagaggggaaaaagcatatgcgtatttccgtaagcgggagctgtcggatgaaacgatgcgcaaatttggcctgggctattcggatcagtacagcgatgatctctatcgctatttaagacatgtgggatatgacgatgcgctgctgaaagagtcggggcttgtctccatcgatgaggtgcgcggaggccatgacaaattctggaatcgtgccatgtttccgatcatggatgtacataaccgggtgatcggatttggagggcgtgtcatgggcgaaggggaaccgaagtatttgaattcgccggagacgaagatttttgacaagagccggaatctgtatggattaaatattgcaaggacaaccagaaaaccgcagctgcttttatgtgagggatatatggatgtcattgcactgcaccaggcaggctttgacaatgcggtggcctctcttggcacatcgcttaccagtggacatgccagtctgctgaaacgctacaccaaagaagtgtatctgacatatgacagtgatggggctggggtaaaggcggcactccgtgcaattccgattttaaaagaagttggaattatcacgaaagtcataaacatgcagccgtacaaagatccggatgaatttatcaaagcacttggggccgaagaatatcagaagcggattgatcaggcggaaaacagttttctgtttgaaatccgtatgctggagcagaattatgatatgaatgatccggagtccaagacggcattttataatgagacggcgcggcggcttttagcctttccggaggagcttgagcgcaacaattatatccaggcggtcgctgataagtacaggattggctttgaggatctgcggaagcttgtgaataatctggcaatggcagggagcgggattacaaaggcggctccgttaaagagcggtatccatgaaaaaaagaaagaagatggcatgaaacagtcacagaagctgcttctgacctggctgatcgaggatacgcggctttttgacagcatcaaaggatggatcacggaggaagatttcacggaaccgctgtatcgcaaagcggcacaggagctgttcacccagtatggggagagcggacaggtgaatccggcaaagattatcagccggtttcaggaggaggaagaacaaaaagaaattgcggggctttttaatgcaaaaattcatgaagtagagacaaaacaggacaaagaaaaagcattaaaggaaacaattgagagaatcaaggaaaacagtattgatgttcgaagccggcagtcagatccgaatgatctgacggtcgttatgcagctgatcaatgaacagaaggaattggagaagctgaagaaaacgcatatttctattgattagggacaaaatagaaagtaacctgagaggacgaaacgacatggcaaagaaaaaagaagagaatgcagcagtggaaacggaagaaacaaaggcaaagttcagagaaaaactgaaaagtctgctggaactgggaaaaaagaaacggaacattctggagtatcaggagatcagcgattttttcagggatatgaatcttgacgaagaaaagatggagaaggttctggatttcctggaagcaaataaagtagatgtcctcaggatcagtgacggggatgatgaggatgatgatatcattctggatgacgaagacgaggtagaagtagaaaagattgatctttcggttccggagggcgtaagtgtcgaggatccggtacgcatgtacttaaaggaaatcggcaaagtgccgctgctgtctgcagacgaagaaattgagctggcacagaagatggaggccggaagtgtggcagttgaaaaaattccactgctcaaagagcgtctggcagaaaccggtgatgaacaggaaaaagaagaaatacaagcggagatcaaagcattgcaactggatgtcgaccgtggatcagatgccaaaaaacgtctggcggaggcaaatcttcgtctggtagtcagcattgccaagcgctatgtgggcaggggcatgctgtttttagacctgattcaggaaggaaatttgggactgatcaaggcggtagaaaaatttgattaccgcaaaggatataagttctccacttatgcaacatggtggatccggcaggcaattacccgtgcaattgcggatcaggcaagaaccatccgtattccggtgcacatggtggaaacgatcaacaagctcattcgtgtcagcagacagctgctgcaggaactcgggcgggaacctacgccggaagaaatcgcggaagagatgaagatgccggtggaacgtgtgcgggaaatcttaaagatttcacaggaaccggtatctttggaaacaccaatcggagaagaggaagattcccatctgggcgattttattaaagatgataatgtaccggtaccggcagatgctgcaacttttacgctgcttaaggaacagctggaagaggtactcggaacactgaccgagcgggagcagaaagtgctgacgcttcgctttggtctggaggatggaagggcgagaacccttgaggaagtcggaaaagagttcaatgtaaccagagaacgaatccgtcagattgaggcaaaagcgctccgtaagcttcgccatcccagcagaagtcgtaagttaaaggattatttagagtaacatgatgaaattatcgaggagaatgaaagcagtggcttccatggttacaaccggcggtatccttgcggatatcggaacagaccatgcgtatgtgccgattgcactggtacagaggcagaaaataaagggagccattgcaatggatattaatgagggaccgcttgcccgggcacaggaacatatccgggcagccaggctggaggaatatatacagaccaggctttcggacggggcagaggcactgcttccaaatgaagcggattccattctgattgcaggaatgggtggagaactgattctgcatattctgacggaaggggaatccgtctgcagtacagcgaaagaactgattttgcagccacagtctgaaatacataaggtccgggaatatctgcgccagcatcagtataaaattgaagatgaagatatggtctgtgaagaaggaaaatattatccgatgatgcgtgccgtaaaaacggagcaggatgaaacgtggaaccggttgaacgatcagacaattgcagtctgtgatatttacggaccgcttcttctgagaaacggaaatccggtactgcgccggtttttggtgcgtcagcatggacagctgacacagattctgcagacgcttgaagcacagaaagaatcggaacagatcatacgacgtattgcagaagtgcaggaaaaattacagcagaatgaatctgcgtatacgattttgggggcgataaaaagtgcaggaatttgagatcacattggagactgcgccggagaaaaccgaactggttctgattccggagcagacaaaactggaacagattgcaaaacaatatcagaaaaattacagtgacaggattgtactggcatgtgtagatggaaagctgcgggaactttcaaaagtggtgaaggcacccggtaaaatttcgtttctgacgatgacggacagggacggcaaacgcacctatcgcagaagtatgacgcttttattgcagaaggcggtagaaaatctgtggaaggatcaggtaaaaatcagggtatattattctctgggagaaagttattactgtgaactgcatggaactgcaaatgatgcagcagccgtgcaggcactgcgtgcagagatgcagcgtctggtagaggccgatttaccgatcaagaaatgcagtgtaaaaacagaagatgcggaacagctgtttcatgataagggaatgaaggacaaagagcggcttttacattatcgcagaagttcgcgtgtcaatatttatgagctggacggacatcaggactattattacggttatatggttccatccacgggatacctcggagtgtttgatctggagttatatgaagacggctttgttcttttgttcccaaataaaaagggagatgaagtggaaccgcttcatacctccaataaactgtaccacacattaaaagaatcacgcagctggagccgtatgctggacgttggaacgatcggtgcgctcaatgatgcaatcgcatccggcaggggtgaacagattattctgcttcaggaagcattgatggaggaacggatcggttccctggcagcacagattgcagcaaaaaaaggaattaaatttgtcatgattgcaggtccgtcttcttccggaaagacgacattttccaaccgcctgtcgattcagcttctggcaaagggaagaaaaccgcatccgatcagtctggatgattattatgatgacagggagcggtgtccgagggatgcagacggaaatcttgattttgaatgtctggaggcactggatgtcagacagtttaatgaagatatgacccggcttctggcaggggagaaagtagatatgccttctttcaatttcaagacgggaaagagggaataccgtggcaggaccctgcagcttaaagaaaatgatattcttgtcatagagggaattcatggtctgaacgataagctgtcgtatacacttcccgcagaaagtaaatttaagatttatatttctgcgctgacacagttgaatattgatgaacacaatccgctgtccacgacggactgccgtctgttacgccggatcgtgagagatgccagaacccgtggaacgacggcacaggagacgattgcgatgtggaaatctgtgcgaaggggagaagaaaaaaatattttcccgtttcaggacagtgcggatgtcatgtttaattccgctttactgtatgaggttgcggtgcttaaagtatatgcggaaccgcttctgtttcagattccgcgtgacagtgcagaatatctggaagcgaagcgtctgcttaagtttttggactattttctgccgcttccgacggaaggaattgcacagagttctctggtgcgggaatttgtcggaggaagttgttttaatgtataaaaacacggtaaactttacggcttgaaccttactggaaactgtgttatagtggaaaagcatcttaagatggaggacaggtgatcgcggctgcaggtgtcgaaagaccgcaggtgaggaaagtccgggcttcacagggcaggatgccggttaacggccggtggaggaaactctaaggaaagtgcaacagaaatataccgctataagagatgcatcacagatgcacctctatagtaagggtggaatggcagtgtaagagactaccgcctcgctggtaacagagagggcacatgtaaaccccattcgaagcaagaccgaaacaaagcgctgacgtggcccgccagctttaggtaggtcgcttgagacggttggcaacaatcgtactagatagatgatcacccaacgacataacccggcttatcgtccttcttcttaagatgttttccgtaaatatcagcagtattctttggaaattttcatttttcacgtctataccattataaatttcccggatttctaaacactttatgaaaagtgtatgaaaagaaaatacgttgcttgacgatatgatttcccatgatatataactaatataagacacgaaaaatatcgacgaaacacagaaaagaggaattgtatgagagacaaattgtatcgttttatgcagggaagaaatggcatggatgaactggcacggatgcagtcctggcttgttctgattcttttgcttgtcggtatgtttacacgcatcggcctgttttcctttgtagcgctgattttaatgatttatatgtatttccgagtattttcaagaaatacatccaaacgttatgaagaaaaccagaagtatttgaatttccgttataaccgcaccgtatcgtggaaccggtttaaaaaacgcatgggacaggcaagggattaccgctttttcaagtgcccgatgtgtaaacaggaagtccgtgtgccgaggggacatggaaagatagagattacctgcccgaaatgcagggaaaaatttattcgcagaacctaaatcggaggcagtatgttcggatatattaatgtaaacggcgcacagctgtcggaagaaaataaaaaaatatatcagtcgtattattgtggactttgccggaaattaaaagagttctgtggaaaaaaaggacaggcacttttgaattatgatatgacatttctggtcgtcctgctgaccggtctgtatgagccggacacgcagactggtgaatttacctgtatgatgcatccgatgaaaaaacggcagctgcgggaaaacgatattcagagttatgcggcacagatgaacgttcttctggcatattacaatctggtggatgactggaaagatgaccataattacacgaagaaaaccattgcctcaatgtttgagaaagattatcagcggatcaaaataaattatccgcggcagactaatgccattgagcagtatatggagaaactggcaacttatgaggcggaaaaacagacgaatattgatcttgtggcagggctgacaggcgagatgctcggagaaatatttgcatggaagcaggacgagtggtatgatgaattgaaaacacttggattttatctgggcaaatttatctacctgatggatgcctacgaggaccgggataaagatgaaaaaaaagacagttacaacccgctccggtatctggatacagaagatgagcaggagtatgagacgttgtgccgtctgatgatgaccagcatgatttcggaatgcgcgaagtcttttgaacgcctgccgattctgcttcacgcggatattctgcggaatattctgtattccggtgtatggtccaagtatgaatacattcagttgaagaaaaagaggaagaaatcatgacagatccatatcaggtgctcggcgtcagccgcagcgcttcggatgaagagataaagaaagcataccgtacattgagccggaagtatcatccggatgcaaatgtcaacaatccgaacaaagatcaggcggaagaacgtttcaaacaggtgcagcaggcctatgatctgattatgaaggaaaaacagcagggaacttccggaagctacagttatggtgcaggttctgcagatggcagatcggcaggcacaggaagctatggacaggggccgtttggagggttcagcggacagtattattatggaaatggaacctaccgttcccagagccgtgcgacttctccaaaattacaggcggcacttaattatattcagaatcagtgttatccggaagcactcaatgtgttaagttcgattccattttccgagcgtgccggacagtggtactattacagtgcggtggcaaatgaaggcgtgggaaacagtgcaacggcgattgagcatatccgccgtgcggtggaacttgagccgagcaatatggagtaccggcagttccagcagcatcttgaatatggcggaacctggtataccaatatggggagtgagtatgagcgtccttatggaaattacagcaatttctgcatgagtctgctgtgtgcgcaggcattgtgtttctgctgtcgcccatgttaattttatatagctgctatattagccttgaaaatagccgcagtttattatatgatagtaaaaatgcgttaagctgaaggaggataaaaatgcggcatttaatgagtcctttagacttctccgtagaggaactggatcagctgttggatctggcgagcgacattgagaagcatccaaagaaatatgcacatgcctgtgatggcaaaaaactggcaacctgtttttatgaaccgagcacaagaacacgattaagtttcgaagctgccatgttaaacctcggtggttctgttttaggtttcgcgagtgctgattcttcatcagcatccaaaggcgagagcatttctgatacgattcgagttatttcctgttatgcagatatctgtgcaatgcggcatccgaaagaaggcgcggcactcgttgcatcccagaagtcccgtatccctgtaatcaatgcaggcgacggtggacatcagcatccaacccagacgttaactgatcttatgactattcgttccctgaaaggaagactggggaatattacgattggtctgtgcggggatctgaaattcggacgaaccgttcattccctgatcaatgcactgatccgttatgaaaacgtgaaatttatcctgatttccccggaagagttaaagattccggattacatccgggaggatgtacttcaggcaaatcatgtggagtttgaggaagtggagcgtttagaagatgccatgagccagctggatgttctttatatgacaagagtacagaaagaacgtttcttcaacgaagaagattatatccgtctgaaagatttctacattctgaccaaagaaaagatggaacttgcgaaggatgacatgatcgtgctgcatccactgcctcgtgtcaatgaaatttccgttgaagtggatgatgatccgcgtgcggcttattttacacaggtacagaatggtgtatacgtccgtatggcactgatcctgacattactgggaatcgaggtggagtaaagatgctgaatattagtggaattcacgagggctttgtactggatcatattcaggcaggaatgagtcttcagatttatcatgatctgaagctggacaagctggattgttccgttgccattattaaaaatgcaaaaagtaataaaatgggcaagaaagatattatcaaagtagagtgtccgattgaagcactggatctggatattctcggttttatcgatcataatattacggtaaatgtgattaagggtgaccggatcgtagagaaaaaggaactgaagcttccgaagcaggtcaaaaatgtcatcaagtgcaaaaatccgcgctgcgtgacatcgatcgagcaggaactggatcagatctttattctggcagatgaggaaaaagaagtgtaccgctgcaagtattgcgaggaaaaatataccaatccgaaccggcgtcagataaaagtaatgtaagaaaaaggggcacatcacgagaggatgtgcttctttttttgggaaagaatatattcaaagatcagcccggcggtgaaccatacaggaaaataatcgaggcggacaagaccggaaatattgtagggagttttactgtaatcccagggacaaagggagaaaagccgcagaatactgccgctgataaattcaacgagcatgatgccggcaccgtaaaaacagccgcgcagaagcacagggcagtggcgcagacgcacggaaagaggtccgatgactgcggcaagtccgtagatcggaaacatccagatggaggtgtgtccgtttaacagcagatctccccgcagcagtccgcccagcgaggtgaacaggatttccatgcaccatccggtcagaccacagataaaaaatgttttccagttcatgaaaagacctcccgcaaaaaatactatgcatgtaggatatgcgattatccggcagatatacttgaaaaaatcacaaaacaattataagataagggtattatggcttattttccaatgtttatagatatcgaaaaaaagaagtgtttagtggcaggcggaggaactgtggcattgcgcaaagtccgggtgcttctggatttcggggcgcagattacggtggtggcaccacagattgacccgcagattctgcagcttacaggaaatgtatgtgtaaaggaacgtacctttgaaccggaggatctgaaggaatgtgttctggttgtggcagctactgatgatgtcacagaaaatcacaggattgcccggatggcacaaaaaaagcatattccggtcaatgccgtggatcagcaggaggactgcagttttatttttccgtcctatctgaaacaccgggatctggtgggggctttttccagtgcgggaaacagtccggtgctcacacagtatttaaaagaatctctgaaagaaattctgacggaagaactgggacagattaacgattatatgggaagtatccgtccggtggtaaaaacgcggatagaaacagaaaaactgcgcagacaggtatatcagaccattcttgccaggctgcttgcagagaaaaaaacttcactgttaccggaagaactggaacagattcttatacaggaaaagcgtatgaaagagtaaaagaaaagaggaacaagggaatggatcgaacaagaagattaagacagactgctgttatgcgaagtatggtcagggaaaatcacgtgaggacagaggaactgatctacccgctttttgttatggaaggggaaaatatcgtacagccggtggaatccatgccgggcatctgccagtattccgttgaccgcatgaacgaagagttagaccgtgtgaaagcattgcagattccggcaattctgatttttggaattccggaacataaggatgaagtggggagcggggcttatgatgagcacggcattgtacagaccgcgatccgccggatcaaaaaggattacccggatctgcttgtgatagcagatgtatgtctctgtgagtatacttcgcatggacattgtggcctgatcagagatggaattattttaaatgatgagacactgccgcttctggcacagacggcggtcagctatgcgcgtgcgggggcagatatcattgcgccgagcgatatgatggacaagcgtgtaggggcgattcgtcaggcacttgatgcggccggatttacctatacaccgattatggcatattccgcaaaatttgcatccggatattacggaccgtttcgtgatgcggcacattctgcgccgggattcggggaccggaaaacttatcagatggaccctgcaaacgggcgtgaagccatgcgggaagtggaagaggatattgcagagggagcagatctgattatcgccaaaccggcaatggcatatatggatatcattacggagatccgcagaaattataatattccgattgttgcctataacgtgagcggggaatattccatggtaaaagcagcggcggcaaacggatggatcgatgagaaaaagatcgtgatggaaaatctgatcgggatgaaacgtgcaggagcagacatgatcattacctatcatgcactggacgtggcagaatggatacagaagggagaagtataacatgacagaccagacatcagaattactttatatgagagcaaaactccggcttccgggaggcgtgaacagcccggtacgtgcgtaccaggctgtagggcgtacgccgcgttttattcagagtgcaaaaggttcccatattaccgatgtggatggaaatgaaatgatcgactatgtatgttcctggggacccgggattctggggcatgccgatccacgtgtcatcgaaaaggtaaaggctgcatgtgaggaaggtcttacgtttggcgccccgacagagcgggaagtggagatggcagaacttctggcacagctggtgccatccatggaagtcagccgtctggtaagctccggaacagaggcaacgatgagtgccatccgtgttgcgcggggatatacgaagcgtgacaagatcatcaaattccgtggatgttatcacggtcattcggacggacttctggtaaaagcaggatctgcggcattgacaacatctgttccggacagtgcgggtgttccggcagattttaccagacatacactggttgcagaatacaattccccggacagcgtcaaggcactgtttgaggcttatccggatgagatcgcagcaatcatcgtggaaccggtggctgcaaatatgggcgttgttccgccggcagacggattcctggagtttttgcgtgagatcacaaaacattacggggcacttttcatctttgacgaggtcatcaccggctttcgtctggcactgggcggagcacaggagtattttcatattacgccggatttgtccacgtttggaaagattattggtggaggtatgccggtcggcgcgtatggtggaagagaggatatcatgcgtatggtttccccggacggtccggtttatcaggcaggaacactttccggcaatccgattgctacggctgcagggcttgccacacttcgtattctggaggcagatacggatatttatatgcggctgcaggaaaatacagcgatgctggcggatgcggtgcgccatgccgcaggaaaccgtgtgcatgtcaatcagatcggctctctgatgagtattttcttcaccggagaagatgtgacagattacgattctgcgacaaccgcggataccaaagcatatgccgattattttgggtttatgcttgatcatggaatttatgtggcaccgtcacagtttgaatccatgtttgtgtccgatgcgcataccgatgcagatatacaaaagaccatccatgtgatgcaggagtactttgcagaatgaaatttggatatataggaattgattataaacatgcagatcaggacatccgtgacagggtgtcctttaccgataatcagaaaattgattttctgcagaaagccgggaaagcaggaattgaacaatgttttgtgctttcgacctgcaatcgcagcgaagtctatttttttgcaccggaagagattgcacagccgcttggcgtgattcgcaccttgtatgaagagatgtttccgggagtagatttttcggaatatctcaaacaacgggaggaaatggatgccatttcctatctgttccgggtgactgcgggattggagtccatggtgctgggagaggaccagattttaggacaggtcagggatgcatttgaattatcacggacggttggaagtaccgggaaagagttaaaccgtgtggtacaggatgcggtcacctgtgcaaaaaagataaagacaaagttaagaatcagtgaacggccgctttcggtcagctatgtgggaatccgccagctgcaggaaacgtttggaattgcagggaaaaaagcactggttgtgggaagcggacatacggcaacgctggctctgcgttatctgtatgaatacggggcctctcatgtaacagtctgcagccggacattttcacatgccggaaatctcctgcatgagtttcccacacttaccatcattccgtttgaaaagcggtatgaagcaatgaaggagtgtgagctggtagtttccgctacagcctccccgcatcatattatccgggaaaaagacatacagttgttacatccgactgcaattttggacctggcatctccgcgggatgtggagacggcgattggacgaaattcccaggcacttctgattaatcttgacagtttaaatgaaattgtagagacgaaccggaagcagcgggaagaactggtgcaaaaaggtcagcgcatgataggggaagccatcggggaaaccagggaatggctggcaacgaccggtgtcgatgagacgatcgcttcgttgcagcagcgctgtacggaaattgtagaggacagttatgcatatctaaaccgcaaactggatctgagtacgagggatcagaaaattgtaaaaaagattttaaaggcatcattaaagcgtctgatccgggagccgatcttggagcttaaacagacggaatccaaagagcagcaggaacagtataaaaaggtattgcaggatttatttcagtttgataccgaaatccgggagtagggagaaaaagaatgaatgtgatcattggaacgagaggatcaaaactggcattggcgcaggcagagtatgtaaaaaaccgcctacagaaacattatccacaaaacagttacgaactgaaaattatatccacaaaaggcgaccgggaacagaaaaaagcgttagaccagattggggataaaggactttttgtgagggaaattgaacaggaactgctggatggaacgatcagccttgcagtacacagtatgaaagatatgccggccgaacagccgtccggacttgtgtttgcacatgcatggaaacgggaagatccgagggatgtattgattttgcgggaagccgtttcactggaggaacttccacagcatgctgtgatcggcaccggaagccgaagaagggcatttcagcttctgcagcttcgaaaggatctgcgcattacgggaatacgcggaaatgtcgataccagaataaaaaagatgcaggaagaacaactggacggaattgtactcgcggcggcgggactgcaccggctggggagaacttctttgatcacgcagtattttgagccggaacagatgataccggcagcggcacaggggacgctggcactggaattgcgggaaggcgacaaagaattgtccgggcaggtgaatgcactttcagatatcgtgacggaggagattacatgtgccgagcggctgtttttgaagggaaccgggggggactgccatatgccgatcggagcatatgcctgcaaattgcccgatggaaggatgcaattgcttggaatggtcggaagtgcggatggaagcagtataaagaaatgtaaggttttcggagagacaccgcaggaagcggcacagcgtgcattgcgggaaaccgggtgtacccgataggggttcggttgcgggcaataccgcagaagtggtataataagatagatttttatttgcaaaaccaatgccggaaaatgaattttcagcatttattaaaaagcagcagtgctgacagggaaaggaaaaaagaatggcatctatggtatatctggtcggtgcaggtccgggagatccgggacttgtcacagtcaagggactggaattgataaaaaaagcggactgtattatttatgacagactttcgtctccggaattattggggtatgcaggaatggactgtgagcgtatttatgtaggaaaagcggaccggcatcatacgcttccgcaggaacagatcaatgaactgctggtcgagaaggcaaaagaatatcattgcgttgttcgtttaaaagggggagatgtctttgttttcgggcgtggaggagaagaaggcctttatctgcgggaacatggaatctcctataccgttgttccgggggtgacttctgccattgcaggacctgcttatgcaggaattccggtcacacaccgtggtgttgccacaagctttcgggtgatcaccggacaccaaaaaaacggagaggatctgtcagaacctgattttacaacgatgtcagattcaaaagaaactctgatttttctcatgggactttcgagagtaagacagattgtggatggactgatgcaggcaggaagaaaccggcagacaccggcagctgtgatttcccatgctacgacagaagcgcaggagatttgtgagggtacgctggagaatctggcagatcgtgtggaagaggcgaaactgacctctccggcactgatcattgttggggatgtggttgcacttcgccgccagctgcatttttttgaagagaagccgctgtgggggaaacattatctggttgcaaaaattggtccaaaaccttcacgtctggccgccatgctccgggcaaagggggcatataccagtgagtgtatgacaggtgagattgtcggtgtgccggcagtgtataccgcacaggaactggcgcatgtggacgtattattgttcacaagtgccaatggtgtggattattttatgaaaaatgtatttgcatcggggctggatgcacgggcacttttccataccagatgtgcagtgattggacaaaagacggcagaaaaactgcgggagtatggaatttgtgcagactttatgccggaacattccaacagtacgaatctggcacaggaattaaaggaatatctggatcaggaatttcgcggagatccgtttaagcgggcagtaatctggtatcctaccgcaaaaaatgcaaaggataaccttgtggatacactgctttctttctgtgattgcggacggctcaatgtatacgaaaatgtaccttgtccgatggaggtgccagtggacaaggatgtatacgatgcgatcttttttacctgtgcgtcttcggcggagcggatgcttggcagtttaaagccacaggagagagaaacactggcatccgttacggatatttattcgattgggccgaaatgcagtgcagcactgggagaacttggcgtttctccggtgattgaggctgctgtaaatacctatgagggcctggtcaactgtgttttgagaaaagaataagtatgaagtatgcaaatattattgtagatatatcggtagaaaaactggataaaacttttcaatacagcatcccggaaaatctgcaggaggaaatacaggttggtgtacaggtggatattccatttggaaatcgtaaactgacagggtatgtcattgaactgacggaggatgccgaatttgatcccagacggattcgccccattatttcggtacatgagggaagcgtggcaatggaatcccagctcattgcactggccggatggatgcggaagaattacggttccactatgaatcaggcactaaagaccgtactcccgatccgcaggcagacgaaagaagtacagaagcgggagattgtattactgattccgaagacagaggcgcagcagaaactggcactctttgaacagaaacactatacggcgaaagcaaggctgctgcgggaactgatacaggaatccgtactggattattcgcttgtcaccggaaaactgaatatatcagcagcagtgatccggggtatggcacagcagcagattcttaaggtggagagcagcagacagtttcgcaatcctgtgtcacatatggatcagaagggatatcatctgacactgaatgaaaatcagcagcgtgttgtgaacacagtatgttcggatctggatgctggaattcataaaacgtatctgctcaggggagtaaccggaagcggaaaaacagaagtttatatggaactgattgcgcatacggtggcacagggacggcaggcaattgtcctgatcccggagattgcactcacctatcagaccgtgatgcgcttttataaccggtttggggaccgggtatccattatgaattccaaactttcccagggagagcgctttgatcagtttgaacgtgccaaggcgggggatattgatattatgatcggacccaggtctgcgttgttcacaccatttccgcatttagggcttattattatagatgaggaacatgaaacgtcttataaaagtgagacggcaccgcggtatcatgccagggatgttgcaatcgagagggcgcgcatgaatgatgcatcggtacttcttggttctgccactccttcagtggacagttattatcaggcaatgcagggaaaatatcagcttctgacgttgtctgagcgtgtggagaagaaaccgctgccggattgcgaggtcgtagatctgcgcagtgaattgcgggcaggaaaccgttccatcttttcggagagattgcaggaactgatggaagaccggttaaaaaaacgtcagcagatcatgctgtttttaaatcggagaggaatttccggatttatttcatgcagagcctgcggatatgtgatacaatgtcctcattgtgatgtttcgctgagccagcatgcgggaggccggatggtctgtcattattgcggatatgagcagccattgccaaagatctgtccatcctgcggcagtaaatatttaggcggattcaaggcgggcacgcagaagattgagatgctggtgcggcagagatttccacaggcacgtgtgatgcgtatggattttgataccacacgaaccaaggatgcttatgagaagattctgcatgcatttgccaatcaggaggcagatatcctgatcggcacacagatgattgtcaaagggcatgattttccgaatgtgacgctggtaggagtacttgccgcagatatgtctctgcatgttccggattttcatgcatcggagcggacgtttcagctgctgacccaggcggtgggacgtgccgggcggggaaaggaaccgggacaggcggtaatccagacgtatgatccggatcattttgcaattcagaccgcaaaggaacaggattacgatgcattttataagcaggagattgcctatcggagaatgcttgcctatccgccggtgtggcagctgcttctgattcattgtacgggaaccgatccgcaggtgacgacagctgcagccagggatctggcagaatttctgcatcgcgtgatatcacagaaaggcaaaaatattatgctggtaggaccggcagatgcatccattgcaaaaatcagtgatgtttaccgaaaggtcatttacatgaaggcaccggaatatgcgacgctggtggcatgtaaggatctggtggaacgaaaaataaaaaataacagcacattttccaatgtgtctgtacagtttgattttaacccaacaagtggtttttaggaggtaattatggcacttagaacaattcgaattcagggagatcccgtattgacaaaagtatgcagaccgattccggaggtgacggatcgcatccgtactctggcggaagatatgctggagaccatgtatgaggcaaacggtgtaggtcttgcggcaccgcaggttggaattttaaaacgtatggtagtcattgatatcggggacggacagggaccgtttattatgatcaacccggaaattatcgagtctgacggagagcagaccggagatgaaggatgcttaagtcttccgggaaaagcaggtcaggttacacgtccgaaccatgtaaaagcaaaattttatgatctggacatgaatgagtgggaagtagaaggcgaaggtctgatggcacgctgcatttgccatgaactggatcatctggatggacatatgtatacagaaaaagtagaaggcggacttcatgatgtgaattatgaggagccggaagaggaataatatgaaagtaatttttatgggaacaccggattttgcggtgaatacattggaaaagatcatagaagccggacacgaggttatgcttgtggttacacagccggacaaaccaaagggacgcgggaataccatgcagtttccaccggtaaaggaatgtgcggtttcccatggactggaagtattccagccggtaaaaatccgggaagatgcaagtgtggaatatttgaaaaagtttgcgccggatatcatcatagtggcggctttcgggcagattcttccaaagagtattctcgatcttccgaaatacggatgcattaatgtacatgcatccctgcttccgaaatatcgtggtgccgcaccgatccagtgggcggtcatcaatggagatgagatcacgggagttacgactatgcgcatggatgtcggactggataccggagatatcattgccaaaaaacaggtgcgcattgcagaagatgagacaggtggaagtctgtttgacaagctggcggcagtcggcgccgagttgtgtgtggaaaccatgcagatgctggaaaacaaaacggcgacctttacaccgcaggacaatgaggcgagtacccacacaaagatgatttccaaggagctgggagatattgactggaaaaagccggcggtggagattgagcgcctgatccgtggattaaatccatggccgagtgcctatacccatctggataataaagcgtttaagatctggaaagcccgggtggtggagacagatggcgcttatgcaccggggtgtatctgtaaagttggaaaaaatacgatggtggtacagaccggagagggtggactggaacttttggaagtacagcttgccggtaagaaacggatggatgcaggatcatttctgcgtggctatccggttgcagagggatcttttttacagcagtaagacggaggtagatttatgccatacatttattgggacagtacctatatactggttgttatcggtgcagtgatctgtatgattgcatctgcacgggtaaagacaacgttcaacaaatattccgcataccgcagtatgtcaggaatgacgggagcacaggcggcagagcggattttgcacgcagcaggaatctatgatgtgcgggtgcagcatgtatcgggaaatctgaccgatcattacaatcctgccaataagacactcaatctttccgacagtgtctgcaatcagacttcggttgcagctgtgggtgtggcagcacatgaatgcggacatgcgatccagcatgccagaggatatgtgccgcttcggctgcgtaccgcatttgtgccgattgcaaactttggttccatgcttgcatggccggtgatcattcttggtgtgatcataaacagccgttcctccatgatgcttatcaatatcggaattctgctgttttcgtttgctgtgttattccagctgattacgcttccggttgagtttgatgcttcgcgtcgtgcgatggttcagctgagggaacagggaatcctgggagatcaggaactccattacacaagaaaagttcttacagcagcagcactcacgtatgtggcaagtgcagcagctgcgattctgcagctgcttcgaatcgttttactgtttggaggaagaagtcgtgacgactaaggtcaatgagagagcactggtgctggaaatgcttctggcggtcaatgaggagggacagtacagtcatctggtcctccgcgatgtgctcgataaatatcagtatctgggaaaacaggaacgcgcttttctgacgcgcctgatggaaggaacgctggaaagacagctgacactggactatgtgatcgatcagttttccaaaaccagagtaaagaaaatgaaaccgctcatccgcaatcttatgcgcatgagcgtttatcagattatgtatatggacagtgtgccggattccgcagtgtgcaacgaggcggtaaagcttgcgagaaagcgtgggttttctggcctgagcggatttgtcaacggtgtgctgcgtagtgtggcaagaggatggagagaagttcgcttcccgaatctgagcgttacatattcgatgccggaatggatcgtggacatatggaccgaaaattatggagaggaaaagacccgtcagattctggagggacttaccgcagaaaaccggctgacgatccgtaccaatctttccgctgtgacaccggaagaactcgtaaacaaacttaaatcagaaggggtgacagtacatgcggttccggaactgccgtatgcttttgaaatatccgggctggattatctggcgggactgaaaagttttaaagaagggctgttttatgtacaggatgtcagctccatgctggttgcggaaactgcggcaccgaaaaagaatgattatgtgattgatgtgtgtgcggcaccgggaggaaagagtacccatatggcagaactgcttcagggaagtggtatggtagaggcaagggatctgacagaatataaggtggatctgatccgggagaacatagccagacatggattgtcaaatatgaaagcggtacagatggatgcaacggtggatgatccggattcccatcagaaagcggacgtcttagtctgtgatctgccgtgttccggacttggcgttatgggaaagaagacggatatccgttataagatgaccaaagaaaaggcggcagagcttgcaaaactgcaaagacagattctttctgttgtatgggattatgtcagaccgggcgggacacttgtgtacagtacctgtacgatccaccggtcagaaaatgaggataacaccgcatggtttttaaaagaacatccggaattttccctggaattccagagacagattttcccgggagaagccggaagtgacggattttttcttgcaaagctggtaaggagtaaataagaggatgagtgaaaagacagatattaagtccatggatctggaagaattaaaaacctttttttccgatatgggggagaaagcgtttcgtgcaaagcaggtatatgagtggttacatgtgcggcaggtggaaagctttgaggagatgacgaatctttccaaaaccttgcgggagagactggatgagacctgcaggatcatcacactcagaaaagaacaggtacagatttcaaaactggatggaacccgcaaatatctgtttttactggaagacggaaatgtcattgagagtgtgctgatgaaatataagcacggaaattccgtatgtatttcttcacaggtcggctgtcggatgggatgccggttctgtgcatcaacactggacggactggtgagaggacttgcaccggcggaaatgctggatcagatctatcagattggtaaggatatcggagagcggatttcgaatgttgttgtcatgggcaccggggaaccgatggataattttgataatctggtaaaatttatcactttgctgacggatgagaacggacttcacatcagccagagaaacctgactgtttccacctgcggaattgttccgcggatgcgggaactggcggataaaaaacttgcgattacgctggcattatctttacatgcttccaaccagaaaaaacgtctggagctgatgccggtggcgaacaaatatgacattcatgaagtaattgatgcctgcaggtattattttgaacagaccggcagacgtgtgacgtttgagtacagtctggtaggtggtgtcaatgatacaaaagaagatgcaaaagaactgacggaactgatccacgggatgaactgtcatgtaaatctgattccggtgaatccgatcagggagcgggattatgtgcagtcaaatgcacatgtcatcgaagcttttaaggagaaactggaacggagtggtttaacggtgacagtacgccgtgagatggggcgtgatattgatggtgcctgcggacaattaaggcgcaagtacaaagagaatcagagacttgcataacgaaaagtcatgtgctaagatagacagatgatggaagagtatgtatattacatgtaattgagaaaggataaagcggatgaagacgtattccataacggatacaggcattcttcgtgaaatgaatcaggattattttttcgcgtcggatgaacccgttgggaatctcccgaatctgtacattgttgcagatggcatggggggacacaaggcaggagattacgcatcgcgttacacaacgcagcgcatcgttgcatccgtgtcccggagttcgggagaagaaccagttacaattttaaaagaggcaataacaactgcaaacagacttctgatcacagaagctgcagaagatgaagcgaaaaaaggtatggggacgacacttgttgcagccaccattattgacggacggctttatgttgcaaatgtcggagacagcagactgtatatcatcggtacggatggcatccggcagatcacaagggatcattctcttgtggcagagatggtcaggatcggtgaagtaggtgcaaaggaagcacgtgagcacccggacaaaaatattatcacccgcgcagtcggtgcaggggaagaagtagaggcagatttttttgaagtggaattaaagaaagatgaccacatcttaatctgtacggacggactcacgaatatggtggaagacgaagaaatctgtagtattattctgcgggatgcttccattgaggaacgcgccggacttcttgtaaaaactgcaaatgacaacggtggaaaagacaatattacagtaatgattatagaaccattttcttgatgaggtgaaagaatgttaacagttgggacgtatttagcagatcgctatgaaatcgtaagtaagattggtgcaggcgggatgtccgatgtttataaagcaaaggatcatgtgcttggccgttttgtggcaataaaagtattaaaaccggaattttcggaagatcgtggatttgtagcaaaatttcgcacggaggcacagtcagcagcagggctggagcatccaaatattgtaaatatctatgatgtaggaagcgaagaggggcttcattatatcgtcatggaatatgttgagggaatcacacttaagacatacattgaaaagaaaggacagttatcctttaaggaagccgtcagtattgccattcaggtagcaagaggtattgaagctgcccacaacaaacagatcatccatcgggatatcaaaccgcagaatatcatgatctccacagagggaaaagtcaaggtcatggactttggtattgccagagccgcatcttccaataccgtcagctcggatgtgatgggatcggttcattattcttctccggagcaggcgagaaacgggtttgtagacggaagaagcgatatctattctctgggtattgttatgtatgaaatggtaaccggacgtgtaccttttgacggagatacaacggttgcagtcgctattcagcatctgcaggaagagatgacacctccaagtgtgtatgcaaagaatctgccgatcagcatggagaagattatcttaaaatgtacacagaagaatgcggaccgccgttaccagaccattggagatctgctggcggacctgcgcagatcgctggtacatccggatgaggattttgttgtgattgctccgcttgtggacaatggaaagaccaaggtcatcagtggggaagaattaaagcagatcaaagaacacgggggggagccaaaagaagacaggcacgcttctaagctggaatcttcctatgatccggatgaggatgaggacgatgaggatgaggacgaaaacgaaggactcagtccgaagatggataaggcaatgaccatcatgggaattgtggtgtttgttgtaatccttgcagtgattatttaccttgtgggaagtttctttggcttattccgttttggcagtaattcatcaaagaatacagaaacgcagacgcagacacagacgcagacacagacacagacagaaagtgaacagcctgtcatggtacagaatgtatgcggaaagttacaggaggaggcacagtctgaactggaagcacaggggctgtatatgtttgttattcaggagcagaagtcggatcagccggaaggaaccgttctgaatcaggacccggttggtggttctgaagtatctgccggaacgacaatcaatgtaattgttgccggaacagaaaatgtggatttcacagattcggagagtcagagtgagcagaacgatgttccggttccaaatgtagttggaaaactggaaaaagatgcttcttctaccctttcggctgccggatttaaagtgtccaaaacatacaaatatgatgattccgtagatgcaggaaaggttgtttcccagagcccgagaggcggaaatgcacaggagggaagtacggttacgattgtgatcagtcagggaaagaagtctagtacggtgccatttgttcagggtcactccaagaaagatgcacaggcggctttgcagaaggctggcttaaaagttgcagtgaaagaagaatacagtgattctgtcaaagcaggtcaggtaatttcacagagtgtagcatccggcaagattgtaccggcagatacaacggtaacgattacggtaagcaagggaccggaagagataaattacagctataaattctcaaagtcatatgcagcaccggaaggagcagtcagtgcaacttatacactgacgggaagtgatggcacgacctatgcaagcggaaccagtgatgtcgatggttctcttacgatcggggcatccgatatggcatgtgagtccggtaaagtgacgattacctggagcattgaagaaatagatgatgaaggtctttccgatacgtctacaaagacagaaacacattctgtcagcttttcaaaacagtaggtaatatatgaagggaaagattgtaaaaggaatttccggtttctactacgttcacgtggcagaaaccggaatttatgaatgtaaggcaaaaggaattttccgtaatcagaagatcaaacctctcgtgggtgatgatgtggaaatcgttgtactggatgaagaaaaaaagattggaaatgtagaaaaaattcttccacgtaccagggaactgatccgccccgcagtggcaaatatcgatatggcactcgtaattttcgcggctgcaaaaccggacccgaattttaatctgctggatcgctttttgtgtatgatggaatatcagaaagttccggttacgatatgctttaacaaatgcgatctggtgacggaagaacaaagagaagtattacgaaaaatttatgaactggcggggtatgagctgctctttacaagtgcaaagacacaggaaaatgtggaaaaactcaaatctgtgttgcagggaaagatgacggcagtggcaggaccgtccggagtaggaaaatcttcgctgatcaatgatctgcaggatgcggtgcagatgcagaccggaggaatcagtgacaagattgagcggggaaaacatacgacacgccattcgcagattataccaattgcggaaaacacctatattatggatactccggggtttagttctatggatctgcccggattttccaaagaggatctgtggacatgttatccggagttcgtgcgttttgagcctggatgcagatttatcggatgcagtcacatcggagagccggattgcggtgttaagacggcacttgcagaaggaaaaatatcgcaggtgaggtatgataattacgtgcagctttatcaggaaatgaagaatatgcgcaagtattaggaggaatcaatgaactgtttatcaccgtcaattttatcggcagattttgctaatctgggagaacaaattcggttgctggatcaggcaggtgcggaatatgtacacatcgatgttatggatggaatgtttgttccgagtatttcgtttgcatttccgatcattcgttccattcgtaaatgtaccgatcggatttttgatgtccatctgatgattgaggaaccgattcgctatatagatgattttgttgatgcgggagcggatattattacggtccatgcagaagcatgcaggcatcttgaccgcacagtggaggcaatcagggaaaagggagttctggccggtgtggcattaaatccggccactccgctggaaactgtccgatatattcttccgaaggtggacatgcttcttatcatgaccgttaatccgggattcggaggacagaaactgattccgtatacgttagataaagtgcgtgaagcgagaaatcttgtgaagcagtccggatgtaagaccgatattgaagtagatgggggaattaatctggaaaatgtggaagaagccatggatgcaggagccaacataattgtggcaggttctgcggttttcaagggagagatcgaaaagaatgtggaagcatttctggaaaagttgcaaaggcaggggtagaagatgaagtatttaattgtttccgggggagaagtgaaggaaggttttttaacctggattgtaaaaaatggaggatttgatgtcatattagcggcagatgcgggaatggaagcattgtatcgggatcatattctgccggatatcatagtgggggattttgattcggtaaatccggatacccttgaatattttcatgacaaagagcagatcgaggtgtgcatgctgaatccggaaaaggatgataccgacacggaatatgcgattcgggaggccattcgcagaggtgcaatggagattgtggtcattggtgcaaccggtaccagaattgatcatgtactgggcaatatcagtctgcttggtattggtctggaggaacagataaagatcagcctggtcgatgaacataatcgtatccgcatgattaatcagccgttgacgatccggaaagcggagcagtatggaaagtatgtttctttgattccattttctgaaaaagtaagtggtgttaccctgcgtggattaaagtatccgcttacggattatacgatgggaggatttaattctctcggaatcagcaatgaaattgtttcagatgaagcgtcaatttctttatcttccggacaacttattgtaattgaatcaaaagattgaagattttatgaaatgacggaaagatggtacgaaagaagtagttcgtaccataaaaaatagcaaatattatggaaaaatgcttgcattggagtaataagtctgctatgattactaagacgaaggtgtcagaagagaattcttttgacgccttttttgcgtttaaaagtataaaagaatggaggaagattagatgaacgcaggggatacgggatttatgctgatatgttcagcactggtgttttttatgacacctggattagcctttttctatggaggactggtgcgaagaaagaatgtcgtcagcaccatgatggcatgcgcagcgattatgggattgtcggttgtcatgtgggtattgtttggatattcactgtcttttggtggaaatcatgcaggaattattggagatttccggtggtttggcttgcatggaattaaaatgaatgaagcaggtccatatgcgtcgacgataccgcatctggtttatattgcatttcagatgatgtttgccatgattacacctgcactgatcacgggttcccttgtgggtcgtgtaaaatttaaggcattgtttttatttattatgttctggtccgtcattgtatactatccaatggcacacatggtatggggacagggaggattacttgcagaaatcggatcggttgattttgccggaggaaatgtggtacatatcagttccggtgtcagtgcactggtattttccattatccttggcaggcgaagaggatatgaacagacggcataccgggtacataacattccgtttgtagcactcggagcatttattttatggtttggatggtttggatttaacgcaggaagtgcattggcagcaaacggactggcagcacatgcatttatgacaactgcacttgccagtgcaagcgccatgatgtcctggatgtttattgatgtgatcaaggatggaaagcctaccttagtaggtgcctctaccggtctggttgttggactggttgcaattacaccgggagctggatttgttccgatctggtcggcaattatcatcggagcactggtcagcccgatctgctgtggtaccatttccctgttgaaaggaagattaaagattgatgatgcactcgatgcatttggctgccatggcatcggaggagtctggggaggaattgcaaccggattgtttgcaaaacattctatcaatccggtcgcccgctgggatggactgttttttggaaattaccgtttatttgttgcacagattattggaattgttgtgacagttgccgtggcgattgtcggtacactggtctgcctttgcattgtaagattgtttacggagcttcgtgtagatgaaaaagcagaaaaagttggtctggatatttcgcagcatggagagagtgcgtatccgacatttaatggtctggattcataagtcccagaaacagacctcgtatgttataatggatccgtcagttatttcgagacagagataaatctggtagtataaaataatcatgtataaggagaaaaaagaagcttatgatgataaaagtggaagcaatcgtccgggaagaagtttttgaggatgtaaaggaagcattaaacgcgattgatgtgaatggtatcaccgtatcacaagtgatgggatgcggtgcacagaggggatataaaaagagagtgcgtggtacagaagtagatgttatgatgcagccgaagattaagtttgagattgtggtatcgtccgaggaatgggagaaagcgaccattgatgccattcagaaggctgcatttaccggagaagtcggggatggaaagattttcagctatgagatccgtactgctacaaagatccgtaccagagagagcggggctgacgccttaaattagatttttaacagaatttacagcattgagttttggtaaacaataaaaaggggctgtaaaataagtccctaatataagaaacgccaattccggcaaatgtcggttttggcgtttctttgtattaacttttctatttctaagcaagtctgcatctttgggtataaaaaatggtgcatttaataaagctcggctaatcacgcccgcttaagttttatgcaactttcgtctgtcgttgctttttgttgtgatatttataaagattgaatccacatgaaatcagtgtaagctcgagaattacatttttctcgcctcttcgcaataatcttttatacgctttatcccactttaatacaccaaaagttccctccgattgaatacttcggttcattctcaagagagcaccatgtatggattcaagattttgcagcacttcctgatggatagcagttaattcctgattcattcggatcgttcggtttttgtgtgttctcggacaacattcctgtttatgctgacacccttcacaagattcacattcgtataattcttccgttcttccatatttattatatttcacatgctgtgttctcttgaagaggaattttcgaccgtttggacataagagatttccatctgcatcttttgcaaagtttacagcacgatacggattctcatgatactttttgtccgtcgtttcttttttgtacatggtaaatttcatgtatttttccatgccgtgttcttcacaataaagataattattgtaagaaccgtatccggcatcagcaaccggatatttcggatagtgaccatatgtgcgattgaatttttccatcaaaggaacaaagcattccatatcggatgcatatggttttacgtcgattacagctatgtattcatcacagatggctgcctgtaggttgtatgccggaagtagctgatcgtttcccatgtaatcacgctttaaacgcatgaaagttgcatcatgatctgttttggaataactgtttctttcttctccacaggtctcgatatgatatgcataggatttcaaacgttccagatattcatgcaattcttcgtattgtttttgtcgaatgctttttctatgaccacgtccggaaacgaaagaagtttcatccagtccggttgtttctttgtacatcgtaagtaattcagagacatagtcaaccgcgtacgcttcacgcttttcaaattttattccgagatatccaagtacttcccgattcatagcatcaatcaagagtgaaatcttgtcaaagactttctgccggtttttcacacacgattttttccatacccaggtatatcgattggcatttgcctcaatttttgtcccgtcaatgtatgtatgctgcagatccacgtgatctttggcaaaaatatatgaattaatgtcttcaaatatctgctcgatagaatcggttagttcgtttcggattaagtttccaaatgtagcaaaagaaggcgttttcatgccatcaagaagatacatgtaacgaatgtcattacggcagagcttttctatttctcgtaaggagcagatgccattttccataaaggcaaaaagtattactttaaggagtttttgagcatcacatcttgggcgacctgttttatagcctttctctacaaaatatctggataggtcaatgtgatccataacctcacaaaaagtgtataccggatcggaaatatcgatcaatttttcgatttctaatggtaatttcagctgacgcatagtataattaccattggtattgttatttagtagcataattaattataccaaaaaatcgctcagacctcacggtctgggcgatttttctgtcaggggagtttttttacagcccctttttgcatatcgaatttacctgatacagggaaattataactgaggaccagcagaaaccagtgccttaccagctgcatttccttcatacttggagaagttcttgatgaatcttgctgcaagatccttagcctttgtctcccactcagaagcatcagcataagtatcacgaggatcaagaattcctgtatctacaccgtttaattcggttggtacttcgaaatcgaagtaaggaatcttcttagtagaaacgttgttgatatctccgtttaagattgcatcgatgattccacgggtatctttgatagagatacgctttccggatccgttccatccggtatttacgaggtaagccttagcgccgctcttctgcatcttcttaacgagttcctcagcatactttgtaggatgtaactcaaggaatgcctgtccgaagcaagcagagaatgtaggtgtaggctcagtaattccacgctctgtaccagcaagctttgcagtaaatccggaaaggaagtagtactgtgtctgctctggagtcagaatagatactggaggaagtactccgaaagcatctgctgacaggaagattacgttctttgctgctggagcagaagagattggacgtacgatattcttgatatgatcgattgggtaagaaacacgagtgttctcggtaacgctcttgtctgcgaaatcgatcttgccgtttgcatctacagttacgttctcaagaagagcatctcttctgattgcgttgtagatatctggctcagaatccttatccaggttgataaccttagcatagcatccaccttcgaagttgaaaacgccgttgtcatcccagccgtgctcatcatcaccgatcaggagacgcttaggatctgtagaaagtgtagtctttcctgttccagacagaccgaagaagattgctgtattcttgccatctaaatctgtgtttgcggagcagtgcatagaagccatacccttgagtggaaggaagtagttcatcatagagaacatacctttcttcatttctccgccgtaccatgtattgatgataacctgctctttgcttgtgatgttgaaagctacacatgtctcagagtttaatcctaactctttgtagtttgcaactttagccttagaagcattgtatactacgaaatcaggctcgaaattctcaagttcttcagcggaaggcttgatgaacatgtttgttacgaaatgtgcctgccaagctacctctacgatgaaacggatagccatacgggtgtctttgtttgcaccacagaatgcatctacaacgaaaagtctcttgttgcagagctctttctttgcaatatctttaacaactgcccatgtgtcttctgtcattgggtggttgtcgttcttgtactcatcagatgtccaccatacagtgtcctttgagttcttgtccataacgatatatttgtcttttggagaacgtccggtgtagataccagtcattacgttaactgcaccaagctctgtctcctgaccaacttcatatccttcaaggccagcttttgtctcttcttcgaataatttctcataagaagggttgtgaacgatttctgtggtaccggtgataccatacttgcttaaattgatttctgccatcttgatttaaacctctttctttatagtatagtaagaaaaaattcctttttccctaatttagtattatacataattacccaataaaatcaataaaatttgtatgaaattttcccgtttttgaaattttgggggaatttggtcacatgtttttttcctgtgcttttttcacggtttcaatgaagtgtgttacatcggcatccggttctttggcatagagaattccgtaagggatcgggtgatcccagtcaacagggagtgttacaagagccggatggacatctttccagcattcaattgtgaccatgaggttctgggactgttcacactggttaaatacctcaatatcgtaaaactgcggagcatctgcaatgtgaatctgtggatgcttcaaaatctcggcgcggatcgcatcgacggtatcggaatcgccctgttttaccatcataagtgtttctccatagagatcttcgatgcgcaggcgtttttttgacgccagccggtgttcacgcgacatagaaatgcagtgctgataagtgccgagaggcagaaagttacagcggtccagccagagcgcagagtcacagactccgatgagaaaatcaaattttttgcccagggaggaaatttcggtaagaatgccctgatggtcgtcctcaaaaggaacaatgtgcagccggtaacccggaaacgaagcatttactttgtaccacagatccataaaaggtttgcacggattgagaagagaacttccgatacaaaacgttttttcagaaaggctggcagcggcacgggcttccgcgatggcattccgggaataagaaaaaaggtatttggcatggcggtagatcacctgaccggcgggggtcagatgcagtccctggttagtgcggtgaaacagtttcatgtccagctgtttttccaatgcgtttacctgtttcatgacagaaggtgcggacagataaagtttttccgctgctttgttaaaacttccgcagtcagcggcacagacaaaaacagtgagtaaatgattgaacatatggaaaatacctcctcatatgtattgcttataagttaatacgatattataatatcgattcttctgcgtcaagaaaagaacggttaaaatacaactaagaaaagaataagggagatttaaaagtatgaagtacgaagaaagagcagcatttgaacaggcagatgcctttggaatcggagcaccgaatgatgcatatgcgcagtattttgtcggagattcctttttgcatccgttgaccgatccgaaagaatgtccggtttttatggcaaatgtcacatttgaaccgggatgccggaataactggcatattcatcacgcagataaaggtggtggacagatccttgtctgtaccgccggcgagggtgtatatcaggagtggggcaaagaaccgcagattctgcatccgggggatgtggtatatattaaaccgggtgtaaaacattatcacggagcggcagcagattcctggttcagtcatattgcggtggaatgtccgggagaaaactgcagcaatgagtggtgtgagccggtaacggatgagcaatataacagtgctaaaatagagaggttttaaattatggcagtaaaacagacagcaggaagaacacagttgggagagtttgcgccaaagtttgcagaattgaatgatgatgtgctttttggtgaagtgtggagcagagaagaacaactttccctgcgcgaccgttcccttgtgacggttgtggcactgatggcacagggacttaccgatgaatcattcaaatatcatctgcagagtgcaaaggcaaatggtattaccaaagaggaaatagcagagatcgttacacatgcagcgttttattgcggatggccgaaagcatgggcagtgttccgcatggcaaaagaagtatggaatgaggaaaaatagggaagtataaataaatataaaatatacattgaaaggaagaaaaacatgttagaaaatacatatacactggaaaacggaattaaaatcccaaaattaggactcggtacctggtttatcgatgatagcaaagtggcagaagcggtaagagaagccgtaaaaattggttatcgcatgattgatacggcgcaggcgtacggcaattaagtgatatgttgtgaagtgtagatgtcagatttcccaaacagtgttgtttagcggaaacctccatctgctagtcaaatgcaagcatttgactctcgcgacattcgccaaattgacacgccagcgtgtcagcttggctcattgttcgcggatataacacaacataggcggctggctcatttgtggtgaatgatagattgcagatgttgtattaagaaggtgatactcttttaactgaaactgtaaacatttagcacaaaggaaggagcagcgtatggagttaacatatcattgggaaggcgatgtattgattccagatttggaattggaagatggaagcaattatcagattggcaaatatggcagaatgcgacagaggtatttgtttgaaaatcatcatgccatgtatacacatctggttcttacggaaaaattgtggaaacatctggaagaagtagatatggaatgcaatgacatgatggatatgcttacggtaagaatggctgagcgtgaaggtgtgacggagcacttgaagtcagtagatcagctcggatgggtgcggaagatgaataacatccggagcagagcagaggaagtagtgttgcatgatctgatttatatggattaaaaatagcgggaaatcttaattggtttccagctgtttgacatatgaaaaagttcatagaaaattcagttgattccgtaaagttcctcgcttataatgatattgagacagagagccttttgcggaatcttagaagtgttattctggtgaaaacagtcgatgaatttaaaggaatgaagccggaagatgttgtgaaatacatcgaaggcgaaccgagtattagcgttgttccggttgagccgggattagcaaatatggaaaaaacagatgctacaggacagcgtatagtaggtcttaatacggaaaatgctgaaattaatgaaggattagtcagatttgatattattttttatgtccgtatgaaaaatggactttcgcagattattgtgaatatagaggctcagaaggatgagccgacggaatataaaattttaaatcgggcaatcttttatgtgagcaggctgatttcgtcacaaaaggaaagagattttgtaaatactaactacgatgacattaagcaggtattcagcatatggatatgtatgaacatggatgataacagcctaagccatatccatttgacaaaagatgagatgttaaaaccatgtaattggaaaggtaatctcgacctgttaaacattgtgttaataggaatcacaaatgagattccggagcatgatgaaaaatatgaaatgcaccggttgattggagcattactttcaagtgaactgaaagaacaggaaaaattggatattatagaacatgaatataatattccaatcagtcaagaatttagagaggatgtgagcattatgtgtaatctgagtcagggtattgaagacaaagcaattgctaaaattgtgatgaatatgtataaaataggttatacaccaaatcagatagcagatgctgttggtgtgagtgttgatgaagttgaagcgattattaagaagaaagagcctgcaatggcgtaagctttattaaccaaaaagatctaaaaataagacggcaagtcgtcaacaagttgttgatgatttgccgtctttgttttgtatataggagttattcctcttttttcttagcccttgtcttatagacattatactgattcttgcatttcggagagcagaactcatttcccttacggcttgcgataaatgccctgccacagtgcttacacagcttcatatcgcagtcagaatctgtaagcataaaagagaagcacatctggatcatgacgagcagggaatggaagttccatacgataaccggggcattttccgctaatgagatatggtaagtcggtgatattccgtcaaattcagacattccctgacgatacaggttttttgtctgttcatcaagactgtcgtagtccatataatataagaagcttgtggtaaaggtaaatgcccagtcggaaaattctttcaccagccagtcatagcgttctgcatattccctctgaaaactcatcgtaaaccttccgacactggcgggaatgtatctgatgcagcagcaggcagtgcttacggcaggatttcagagcgctgcggcaggtgcaaatgcaggtatgccggtaatgctaagccctgcaaatggcaatggaaatggcagaattaagcaggggcatactgccgaagcggttctggaggaatcagcagagaaagagccggaggataatgaatttctggattacagctttggtgtgtaaagcaaaagtgcagaagattctatgggacgaaggctataaagccgaaaaatattgacaccacctttgcaggtggcaatatttatccggcgggggttcttagggggctgtgccccttaagcaggtagcaccgatggtgaagacaatgaggaagaaaaaggaaatcgcagaatatcagatgaaaaaacgagataagctgtcgtttcgggaagaaataaaggtgcttctgcgaaataccatgaacagaccggaaaataagacattgcaggatgtgattgattatgcaaagaagtattatctgatggatgttcggctccggggcaataccatatcctatgccctgaaatataggacggataaaaaaggaaagtcgatggcggtcagagggagcaggcttggtgcaagatttactgtcgcagggataacagaatatctgaaaaagaaggaaaagagcagactagagtatgagcgcataaaagcagatattgagcaggaatccggaagatatgatgattatgcggaatggaaagagccttctgatatggataaagatgttaaatgtcttgtcccgaaagacagaagtatggaaacaggtaataagcaggcttcgattgtaagtgattccgttgagaagaagagccttgaaaaagaagaaactgatacaaatgctgatatcagcatttatgagggctttgaccggttctgtgagaaagagaatattcgtgatgacgaggaggaagtgttctatggtgctgcgtttgatgaatttaatcgggagtggcagggaatagcatcagaagaacagacagaaccgacttctcataaagaagagcaggagataccaccagattatacgaagatgtccatacaggagcgtgtcagacagcttccgccgccaacagaggatacttcacgggagtttgaagcatataagaacaggatgggatatggtgcggctaagatgaagagtatccgttataagatgagtgtatatgatgaattcttagaggaactggaagccagaaagaaataccatggaacgaaagcgtatggcagacagagcacaaggaagcgtgacagaggggaaaggtgaaaataattttgatgctcataccatatcggcaattataaaaagtgccgatatggtataatagaaaaacaaaagttattacagggaggagaatggattgttagaagtagcgatatgcgatgatgataaggaagatcttgacaaagcggcgctgatactggataagattctttcagaatatcatgttcaatatcagatacggtcatttctgtcggcgaatgagctgctgaacaataatgacaagattgatatcggaatactggatatttccatggaagaactgggcggaattacgctcggaagaaagctgaaagaaaaaaatcatgatataaaaattatatacatcaccagttatgaagaatacatggcacaggcgagtaataaggtacatgcgttttcttttttgtgtaaaccaatcaatgaagaagaaatgaaaacgcagattatggaaattctggggcaggagaaatatccggaaatagaaaaggaatttgaaatactagatgaatcaggaacaaaaacaggttgtgtgcatttgaaattaaacgagatattatattttgagtacataaaaagatccagaaaagcagcaattatcctggaagattgcagatatgaatgtgaatgtatatttgaaaaccttgtggaagaattgcatccatatgattttgcggtaaatcacagaggctgtcttgtaaatctgagacatattgagaagatacagggatttcatatttatctgtacaattctttttcaatttatgaatgaaagatatgtgtcttatatgggaatgagcaatgtatggcaatgttcaggaaacaaaaaatctaatgagtcattatgaaagtgacggtgattatgttaattataaagtgtcatgtgattaataaggaggacttgcactatgcagattaattctaattattctatgaatggcgtgtcgtatgaaactagatagacataagcagaataatatccctcaatttagtacggaatgtgcggttcagaaaaatgaaaatataaatccatatatggcagaagcagactttgatgaaaaagcatttgatatgattggaccgaatactccacgggatgtaaaagatgcatggatggaagctgctaaggatgtaaatgcaaacggcatgggaataaagaaaaatggaatgttgagccatatatcgcagatgatggtacaaaagaagtttgcactggcgggaggaggaacattgaattgtccaattctaactactggtggttatggtgttgaaattcagtatcagggagtaacggtattatctaatcttggaaatggctggggctatgagatgacaccagcggaacttgcaaaaaaagatgaattttattctatttattggagcgaatataatttagtaaaagagagtggaagttcagaattgagagattatttgaatcaggatagaccatcttttgaagccagagcataaaataaatattgtgcgcaaggaaaaaatgagcataggagcagtgccaggtggcacttttgatttttcaagtgaagtccagaactttatgataagattcataatcgaaacaattatgccgatatatagaaaagaacaggtaaacggatttacgatgtgatatgtacaaggaggacaacagatatgtcaatgaatgtaagcacaaccacggctgcttatgcaaattaccagaacaactacaagactggtacagcaaataagaaaaaagaaacagcacaaacaacagaaaatacgaaattaaaggaaaatacaactgaaagcatcgctgaaaaaaatctcagtaaagcggcacaaaaaatgctggagaatttgcgtggatcaagaaacgacatggattttatggttgccgattttgaaaatggtgataatgccaaagatattttagcccaaagtgataagaaatatacagttattttctcaaaggaagaaatggagaagatggcatcagatccaaaatattatgctgaaaaaatgcatagtattgaaggagctttgcgtatgacagatgaaatcaatgcccagttcggctttgaaagagcattcggtaagactaacgataatgcagatgctgatacaaaaataataaaatttggtatatcttttaatagtgacggaactacaaccttctttgcacaactggaaaaatcatcagccagtcagaaagaatatcttgaaaagcttcaggaaaagaaagctgctgagaagaaagaggcaaagaaaaaggaacagtcaaaacaaaccgaagtaagaaaaactacggttcaggcaaattcaaaagaagaacttttggataagatcaaaaacattgactgggattctatcaaaccggaggagaataaaatcggtggaaggtttgatttttcaatctagtgaatttggaacagatgaaatatatgccaatatggaggaatatattatgcagataacaagagataattattcgcaatatgctcaaatggttcagcagatgttcgggaaaaaagcaagttcaaatgattcgttagctcaatgtgattatggtaatttttcattaagatttaagcctgtggacattaattttaccaaaccaaactgggatactatcatgacaaaacgagataaaccagcgatgtcagaggaagaatttgacgaagcaataaaagaacttgcaagaaaagagtttgctactggaaaaagggatgatgatgcttatcgaaaattgtgtatgcagcatggagaaacagtatctcctgatagaaaggctatatatgaatcaagcatgaaaaaaactggtggcaaaatgaatgctgcatgtatgttttgggattcaaaaggtaataaaacgctttcttataatccagagtcaagaaactggaaagctataagtacagatgaagaatttgcaagagcaagagtgtttacatcaatttataatgatgagttagctcgtttgaaggaagagtatggcgaaaaagcaaaaggaaatgtttcttatagcaaaataaaggcagatatatccgcagagagatcaaaggaaaagaataataatgaaggcaatactattgatttgcaaatttagattgttgattgcgttttagcaaatagtagataaaaaacggaaagatattcgtcgctggtagcagcattgagttcataaattactactactctagataaaagtagtattccgataagttaaaagataaagcagatgcaaatagacatgaatcccagcgtataccaatgaataagtttgtttcatttctttaatagtgcagacatgactagaagacagggcagtgaaccaataatggtttgctgcccttttcacaacaaaaaaaggtcatttcacaacattccagatagatattgcatgaacttatccgatataatagctataaatatatgtaagcaaggaagtgacaatatgcaaatagctatctgtgatgatgaagtatctatggttcagatactggaggaaaaaataaaaaagctattgccggatgcggttatagagaaatatctatcgggcgatgaactgattgcaagtggcagtaagccggatattctttttctggatattcagatgccgggaatggatgggatggaaacggcaaagatgcttcgtcatgacaatgaggatatgatactcatttttgtgacagcagcagaggagtatgtttttcaggcatttgatgtcggagcatttcattatctggttaagccattttccgatgagaaattgaaagaggttgtgacaaaggcagtccataacataaaaaggagtttcaaacttgaaaaggacgaaaagtatatcatggtacagaccgccggaagtcatataaaaattttcctgcgtgatattgtgtatgccgaggtgtataaccggaaagttattatccatacacgaagtacggatattgaatactatggtaaattacaagaattaagtgatatggcaggaacagattttttccgaacacacagagcctatcttgtgcattttaaatatgtagaaaaatatgatgcaacttgtgtaactatgaaaaatggaactgcattgattgcaaaaaagaattatccggagtttgtgaagcaatatctgaagtataaccagaggaaaggaaatgaagtcagatgagtttagtggaaagatgctggatgatcacatcgaagttttctgttattgcaattttgattattacaggaatctgttttggtgtttttgtatatccatatatgaaaaagaaaagggaagctgctctggtcagtattgtttatattggaattatgtctgtgctgtatctgataccgcagcagattggcaatttttctgcatatatgctgggagttatggctgcatttcttgtgatgtatgtacaggacagaagaaacatttatcagaaaatatttcttgcagtgacatttttttccatccgttggcttgcggttgcaatggcagacagactggatgattttatcacaaaagctttggtttttgggaatacgattgcaggaagacaatggctgcaatatggactttatgctggaacgagaattctggatattgtgctttgtatcgttttccttgcagttgcaatcggtctgatcaataaagcatatgtatacaaaaatgatgaaatgaacgttaaagagctggtaatgctcatcataccttctcttgtgggagttacaggatatggcattctgcaatattatctgaatatttatgaaaaagatacaggaaagagcctgacagatacctatggattttatggagctttaagctttgtgcattattttatctctatcatagcaattcttgttatgacaacgatgtttcaaaactggaaggtggcacaggaagaacagacagggcaggagttggtattaaatcaggtcagtaatatgaaaaagcatatcggggaagtggaaaagctgtatcaggatatccgcagcctgcgtcatgacatggggaatcatatacagatgctggaacatcttgtggcagagaatcatatggatgatgcagcagaatatatggagcatttgaaaaaggagtggaatgaaatatctcctgagataaaaacggggagtcctgtcattgatgtgattctgatggaaaagttaagagaagcaaaggaaaagcagattcgttttatatcagattttcattatccgggggatacgaaattaaatgcatttgatttaagcgtgatcttaaacaatgcactggataattgcatggaaaatgtaagtggagaaaatccttatatctgtatctcttcttttcggaaaaacagtatttttatgataaccataaagaacagatatgagggagagttaaattataaggacagtgatctgccggaaacaacgaaatccgggaaggagcatggaattggactgcataatatccggagggttgcaaggatgtatatgggagatatatctttagagcaggagaatcaggaagtggttctaagtattatgttacaggtagaataaggacaaaaagcaccttcgaggtgttttttatttgcttcacaacaaaaaaagggcggttcacaacatcgctgtttattgtaaagaaagatatgccgaaagaatcagtaaagagaaatcatgttgtacagattttaaggaaacggatttcagaatttaagctcaaggaggacaatacgatgaggatcaatggatttagtgggacaaatacgcagacaggaacaatgggaatgacacaggggaatgattctgtaagtaaaaatattcagaatcagattgcaaatgcacagcagaagctacaggatttatcatcgaatgaagaaatgtcattagaggataagatgaaaaagcgtcaggagatacagcaggagattaacaatctcaatcagcagttaagacagcaccagatcgagcagagaaaggaacagcagagtaaaaattcgtcatctatggatgatatggtggctggaacaagtaacacttctaaaaagaaagacaccggattgtcacaggcaagtatgcaggcgatgatctgtgcagattcttccatgaaacaggcaaaggtgcagggaagtatggcaacacagatacagggacgtgccagtgtgcttgaatctgaaatcaaacaggatgccggaaaaggaaatactgagaagaaggaagaagaactggcagagctgcaggcaaaggcacagtcggcgacagcagcacagatgtctacacttgcagatgcaaataaatcagtagaagaagctgcaaaagcggagaacagcaatacagaagacactgcaacaaagaacaatactgataaatccgagaaaacacaggaatctgcgggggctgcggcagaggagacagacaacgtaaagaatacggatatcaaaggggaaacacaggtgacatatacaccgattgatattcgtttatagttggtaaaggagaatggtattatgtcagagattaagagttttagtgattacacaagtaaatataacagcaatgtagattattccgcattatttggaggaacttctgacagttcatccgtaggaaacaccaatatgctttctgattatgctgcgattaaaaacggaagctatggaaaacttatgaaagcatattatgcaaagcaggatgcagaaaaattatcggggaaaggcgatacttcacagaagcttgcactgatgaaaacaaatgcggattccctgaaaaaatcagcagatgcactaaatgatgcgtcactctgggaaaaaaagaaaataaaaaagaaggatgtaaaaactggggaagaaacagaggtagaggattatgactgggatgcaattaccaaaaaagtgaaatcttttattgatgattataatgacgttgttaaggaggcaggagaatccaatacaaaagatgttcttagaaatgcttcatggatgacaggcatgacagacaaaaccagtcatttactttctaaaataggtattaccataggaaaggggaataagctggagctggatgaagatgaattgaagaaagcagatatcagttcattgaaaacggtttttacaggttacaattcctttgcaggcaaaacagcccagaaagcagctggtatatcaaatgctgcgaatcgggcaagtgcgacttatacaaacaatggtacatattcgaaaaaagattcctctctaacgtcaagtaagatagataaggaagtataggaatattgtatgagtgactaatttgagcaaatgtatatcactaattagtaaacatgaaagtgaataggcgattgcgaaatgtgaaaggagcggatatgaaaatatttcaaacaccttcttacgataggttttgtttattctaaatggaaagaaagagtaaagatttcagaggtatggatgacaatgttgcttataaaaataagcagatagacaatgtagaaatatcgaatgaaggaaggcgggcattgcgggaaaaattaagagaagtaaagccaaaagttgaggaaccgataggatatgaattaacaatacaagatacaaatgaggttgaatgggaacattatacttcaatgagagaatatagtggactgacgttaaaagacggaaaatacaatctagaagatgtgatgaagtctatgatggatgcttatgaaacgcgttacaattatattgtaaaagaacatgagaatggagaacgtcggatttcttatgatctcacaggagaaaattcattaacacttgatgaagacttggcaggtttagacagggcatataataagcgattagcaaatctggcgggatatattgtatgtcagcagacaaatgacggttctaaattctttcaaacaactaatatgaagcagaatacagcagaacaaaaagaatatatagatactgcggtatccatgatggagaaagcacaaaaaagatttttagaaatgcgtgaagaaccgaaatacacagcaggaattgcaaagagtgtaatttgggatattatgagtagcgataagaactttatggaaacgactcagaggttatttgctaaaacaatatatcacaatgcttaaaaaaatattttctagagacatgaaaggctgtttaatgttgcaagagaatgttggcagttgttatgagacttatataaggtaggagataatatggttactgtaaataattattacaacaacataccagtaggcagggatttaaataatctgccaaacacttccagtactggtacaactgtaggttatcaatatgatggacttaccgaggaagatcgtttcgtacaaaaagttttgcaggagcattatgataaagtgtacaaagaaaatttgtctcattctgatccaatggcatatatcgaatcaaaatattgtgatgtgacctcacctaatttttgctcatatatgacagaagatcagcgttccatagcttaccgcaatgagaaaagaatgttacaaacagagggaaaatattcggctggatttgcccggtatgattatgcattaagaaattacaaggatgtatatacaggtgcttcaagaagtacaggttatatacgcaatactgacaaggaaaagcaatatgcaagaagtgttgtaaatcagcaaatttcaaatctgttttcaaaaaatggaatatcattatcaaaacaagcagatttgacattttctattgatccatatacatatcaattaactgtgtcaggaaatacagatagagacacattatcgcagatagaaaaattgctgaatgaaggagataatgcaaaaaatatttggacgcatgcgtggatttgtatgcatgattcagacaatgaaattgttaattcgcaagcaaatatgaaaaaggcgaaccaatattctttatggcatgaagtgtatgagacaacagggtatgatgcacgcaatgcgacatatagaaatggtacttttattgcagaggatggcacagatttacttgccttgtttaaggaaaaggctaaaaatggcgcagggtatgaactttattctaatagatggttggaatatgctaagaatggctggaaaaaagaaaatgatttagtattgaaaataggatttgacagcagtggattgtatgatatagggcaggaaagaggatatggagcaacgcagaatatgtggatgaaaggtattagtcaaagtatatttgaagctagcgtgtgatcaatattatattgattctgagagaaatccaacaggtggcatagttggaaagactccgaataatgaaaggagatatgttaatatggcagttacaggaataggaacatatgcgtcatatacgaatagttatggcaatacacaaaatgctggaaacaaaacgggcaggacatataagaatgcccatgaatataagaactatttaacacaaaaatacgattgtttacgaagcagggattattccgtaaatataaacagttctcttttgtcaaaggctatgggagatgaaaagacaaaacaatggttggagtacaatttatcgctaataccaaaaacaatagaacagtcaagagcttatgtggcagcaagaggagcaaagatactgagttatagtattactatagatggatatgatagtatgagttctgtaatgtgtactcaagatgaagttgatccgggaacggaaaaagcaaggaaagaacttgaagaaagactcgtgaaaaggaaagcagaaaagaaagagacagaggaaagactggaaaaacagcgtgccgaaaaacaggagcaggaagaacggcaatataatctgaaaattgatggaaaagatgtagctgacctgacaggaaaaatggtggaattgctaggtacttcaacttctataggagtgatggaaaatggagtttcgacatttgatgtgctggcataggaactttgatatgaaaccgtaaggtgtgcaattaaaataatgacttatgctagaacataaaatagacaaaaataaatttgcaatgtggaaacagacagggaggttgtattatgtcaaggataacggattatgcttttttatttcagaaatcatttggaacatcaggagtaaatgcaataggtagttttcagttgtcacagcttaatagcagttctgttcaagcacaattaaaagctgccggaattaacacgaatagtaaacaatataaatctgctgtaaaacaaatgatgtctgccggaaatggtgcgatgtatggcaatattcagggaataaaaaatctgatgagtcattatgataaggacggagattatattaatccggtaaatggattggcaggacttttggtgacagatgaaaacgagaattcgagaaaacgaatcatatcaatttcggatagcagcaaagaagaaatgtatgaactgacaaaaaaagaatttctgcgtgaaaatggtgtatgcaatggtgatacaacaaaacgaacagatgtgtataacaatttatatcgcaaaatgtccaaaaaggacaggctggctgccgggtacacccttgaaaagtacgaaagaatatatagacaggtattctatgatgcagcaaaaagggctgatcctaactgggaaattggcaaaccaatcaaagctggagcattcgatgacgttacaagagagtctgcggggacagggaaatctcctgcataggcagcacttgatactaaaatctaaagagtataaactattctttttgagaaacaaaggtaatcagctatattgaattaacagatggtataaaagtaatggaaggctctcttatgaaaatagaagcaatttcataaaatctgacatacacacttgacaacatttctctgagcgtggtgtcggggaaggggtccgcacctgtggaatcccgagagaagacttatttgtcgtgtcaaaagttgcagcagagcacaagacatatgagcaggcaatggcgggaatcgatgaaaccttaaagaagatgggactgtattatcaggattttgccgtgttttttgcattttaaactttcagttaaaaatacatatttgaatataaaatacacacaatttgaatacagataaataataaaaagaaaaaataaaaattttaagcaaaatagttgacaatataaaacgcatatggtaatatacagtcaacaaaacaaacaagacctaattacacaagacttccaatcgaaccaagcggttgggaagccaattggaaataaagagaagcttggagtaagcaggaattgaatgagaagaggaggtacagtccaatgggacgataagtaaaatccaaaacttcatggtaagtgtggtagtgtctgatagttttcagcaggaaaagccttttcaaatggatgagaataattcttaaagttattagtagaggataacagagacgatggaaggcaatggatatgtacagacattttacagatgaagatactgcggaaagataccacggaaggtaatttgagggtaggatgtgcggaagaagttcattctataaaaagcgagagagcatacttcagattattattcaatatagagcatacatatcactaattttctaaacaggtggaaacatttgtgagctggaagaattaaattacaaaagaaaggaataaaaaattgaataacgaaaccgagtagaacggtcactgtatttttaaagttgaaagtatggtggccgtttctattataatagtaaagcacaagtggaaatttatttataatttaaatagcaaaaatataggtcaaagtaaaaatggtaaggaaaattatggactatatagcacataaagatggggaaagaatacagactgttttagaacatttaactggaactgcagaactggcaggaaaatttgcagatgtatttggaaaatacgaatggggatattgctgtgggatgcttcacgatattggaaagtattcggaagaatttcaatataaaataaaaaatgatacgaatgaccaagtagaccatgcaacggccggggcaaaactatgtatggaaaaaggcggatattattcattactggcatattgcattgccgggcatcatgcagggcttccagattatggaaatacagcgatttcgtccagtttatgtggaaggttaaagaaaaagatatgtgattataaggtatatgaacatgaggtgaatattccagagctgaaaacagctccatttgtagtaaatgaaaataaagatccagaatttgccttaagtgttttcatgagaatgatttattcctgtctggtggatgctgattttttggatacagaaaaattcatgaaaaataatcacaccaggcgtgaggctggagaacacatggaaaagcttttggaaagactaaaaaactatgtgaagccgtggatggaaaatgccgatttaaattctgtaaatggaagaagaacagaaattttaaaatcctgcatggaaaaaggaaaagaagaaaggggactgtttcatctgacggttccaaccggtgggggaaaaacgattgcatctcttgcatttgcattaaaacatgcggtttctcagcatatggatcacatcatttatgtgattccatatacgagtattattgaacagaatgcacaggtgttccgggaaattctgggagaagaaaatgtattggaaaaccacagcaatgtcgagtatcgcagttcggaagagttaagtcccatgcagcttgcaagtgaaaactgggataaaccggttattgtaacgacaagtgtccagttttttgagtcgctttttgcaaataaatcatccaaatgcagaaagctccataatattgcaaattcggttgtgatatttgatgaagcacaaatgctgccggtggattacctcaaaccctgtgttgcaatgatggaagctcttatggaagattatcggtcaagtattgtaatgtgtacagcaacacagcctgcacttgacggaatatttacagaacatcgtgaatttatggaattgtgtccgaatgtaaaggaacagtttgcgtttttcaggcgggtaaaatatcgaaatcttggatgtgttccaatagacaatctgattggacggttacagaaagaaaaatgtgcattatgtattgtaaatacgaaaaaaagcgcgcaggaaatttatcagcaattaaaagaagagggcgtttatcatctctcgaccagtatgtacccgaagcatagaaaaagagtttttgcaaaaatcagggaacggctgaatcaaaataaaaaatgtgttttgatttctacaagtctggtggaagcaggtgtagatctggatttccattgtgtatatcggcagattgcaggagtagattctattatacaggcggcgggacgctgtaaccgggaaggaaaagaaaaagcagaagacagtctggtttttctgtttgatctggaaaatacaaaggcagcaccggggcagagtttacagattgatattacaaaggcaattttacaggaagttgatgatatttcggatctggaaagtatcacggaatattttaagcggttgtatcattttcgaaaacaaagtctggacaaaaaggatattattggtgaattccgtaatcatgcgtataattttgcaactgcagcaaaagaatttcgcatcattgaagagaaaactaggacgattttgattccgattgagccggaagcagaagaattgctggggcaattgaaaaatcaggggttttcgaaagaacggatgagaagggcatcacaatattgtatacaggtatatgataaagtttttggtattctggaaagtgctggaatggtacggtcgatttcatctgatatggaagagttttatgaattgacggcgattgatcagtatacggaagatatgggattgaatttgtcggtggattcgggaatggatttatatttgtaaaaatgagtggcggtgtaaaaggatcttacaccgccactcatttgcatcactgagaatgtaattatttcaatccacaggtgaaaacctgacatctgtaagtataaatgattttatttatatggtcaataaaaaaataaatttcaattatatttttagtgaactgaaatgaaaatatgcttgattaatgatatatagagtagtattataaataaaaaggaatgaatggttataaaataatgaaaacaagagaggacaggaaatgatcttatatcatggcagcaaagaacaggtagaatacccggaaatccgaaaagcacgttttcacaaggatttttactttggattttattgtacacaacttccggaacaggcaaaacgatgggcaatccggtatgggaaaaaaggttatttaaaccgatataaatatacgccaaataaaaatctgaactatctgatttttgaagaaatgacagaggaatggctggattttgttgtgcagtgcagaaggggaattgcacatacgtatgatattgtagagggaccgatggcggatgatacgatctataattatattcagaattttatggatggaaagatatcaagagcagcgttctgggaactggcaaagtttaatcatcccacacatcagatcagttttcatacaatttcggcattggatacattagaatttatcggaagtgaggttgtctatgggaacaaaaaataataatgatttattttatacctgtagtctgattgaatttatcggaagacagatcaggcagacaagaagaaaagtcacagattttcttacaaaagagaggatccagcggatttatgaatttgcagacatttttcactgtgaaccaatagaaaaagtggcagatgaatttatacaggaatgcaaaatgagttcgggaaattatgataatgtgcaggaatgtaattataaaataccagattattgggatattggggaagtatatgagagattgatcgaagattgttacaaagatgaagaagtcttagatggaatctggaaagtttatcattcgtggatggatgcacagatttccaattataattcggatttttattatcagccgagggattatattgcagcatgttataaggaaggagtgatactttaaatgggagtaggtgtaaaagtgcaggtatggggagactatgctttattttccagaccggaaatgaaagtggagcgttgttcctatgacgttatgacaccatcagcagccagaggcattttggaagctatttactggcacccgggactgcgttgggtaattgataagatttatgtaaaaaatccaatccgttttaccagcgtccggagaaatgaagtaaaaagcaaaatttcagccagcaatgtgctacaggtatataacggggcagacaaaccactgtatctcagcacaaaagatgagatagtgcaacgcgcttctttaattttaaaagatgtatcgtatgtgatcgaggctcattttgagatgacagatcaggcaaatcaaaccgacaatccgggaaaattcaaagatattatgatgcgccgattgaaacgtggagagtgttatcatatgccgtattttggttgccgggaatttccggcacatttttgcctgtgcgaagaggaggagatccatacgatttacgatgaggtaccggaaagagatctgggatttatgctttacgatatggattacagtaataaagaagatattcagccgatgtttttccgggcggtgatgaagcgaggtgtgatcgaccttagggattgcgaggtgatacgatgattttgcaggcactggtaaaagagtatgaaaaccttgcacaaaaaggtctggtatcaaaacctggatggagtcaggcaaaggtttcctatgcaattgatctgaaggatgatgggagtataaaggtaatttattcgttgaagacagaagaacagagaggaaaaaggacggtctggatgccaagtctgttatatgtaccggaaatggtgacccgttcttccggtgttgctgcaaatttcctctgcgataatgccaaatattttcttggaattgacgagaatggaaccaatgatcgtgttttggattgctttcaggcggcaaaagaaaaacatatagcattgctaaaggacattgatgatgttatggcaaaagcaatctgctctttttttgaatcgtggaatccacagacggccagggagaatacttttgttcaggaaaaatgggacgagttaaaggacggtggaaacattattttctgtatggggatggagtacgcacagaatgatgaaaaaataaaggcagtatgggagaattcgattcttcagaaagaggaaggcagaacaggtacatgccttgtgacgggacaaaagacgaaaattgcaagaattcacagaggaatcaaaggcgtacctggggcgcagtcgagtggagccgcactggtttcatttaatgcaccggcatttgaatcatatggaaaagaacaaagttataatgcaccagtgggaaaatatgcagagtttgcttatacgacagcgttaaattacctgttaagcaaaagagaagatacgttttcactgggggattccatgattgtattctgggcagaaaacggaaaaaaagaatatcaggatctgttttgtctttcgatgaatccacagccggataatcaaaaacagttgcagaatgtttttggtaatttgaaagcgaagagaccggtagatctggatgatatcacaattgacctgacaaagcagttttatatattgtgtctggcaccgaatgcagcaagattatcggtgcgctttttctatcagaatacatttggaaatatcttaaaaaatatagaagcacattataaacggatggaaattgtaaggccttcctgggagaaagaaaaaaaatatctgggaatttattccatgcttatggaaacggtgaatatgaaatcaaaagataaaacgccagtttccaatatggccgcgcttgttttacaggcagttttatctggaaaccgatatcctgcaagtttatatacggatacgttgatcaggattcgttctgagcaggggagaattacctgtggaagagcagcaattataaaggcatttttaataaaaaattatcaatggaaagaaggagaagcgtatatgggattagatgagtcaagtagtgatgtttcatacatattgggaagactattttcggtattggagtccattcaaaaggatgcaaatccgggaatcaataccacaatccgggatcggtattttaattccgcgtgtgcaacaccggcatccgtatttcccgtcctgttaaaattaaaaaacagtcatgtcaaaaagctggaacgtgaaattgggggtggatcaaaaatttattatgaaaaattgctgacagaacttatgggcagaatcagtggttttccgcaacgtttaaatttggaagagcagggaaaatttatacttggatattatcatcagacacagaaaaagtatgaaaaaaaggaggacaagtaaatgggagaagcaattaaaaacagatatgaatttgttgtattatttgatgtggagaacggaaatccaaacggggatccagatgcaggaaacatgccgcgaattgatccggaaagtggattggggcttgtgaccgatgtgtgtttaaaacgtaagatccgcaactatattgagaccgtgaaagaagacgagccgggatataaaatttatattaaggaaaatgtgccgctgaaccgaagtgacagggaagcatgcgagagtcttggagtgacggagacagaggacaagaaagtgacggaagcgttgaaaaaattaaaaaaatctgatccggatgcagacgtcaaactgcgagattatatgtgtgaaaatttttatgatattcgtgcgtttggtgctgtcatgacaacgtttgtgaaggcttctctcaattgcggtcaggtgcggggaccggtgcagcttggttttgcaagaagtattgatccggttatcagtcaggaagttaccattacaagggtggcaattacaactgaaaaagatgcggaaaacaaaagcacagaaatgggaagaaagagtattgttccgtatggtttgtatcgggtagaaggatatgtttctgcaaatctggcaagaaaagtcacaggattttcggaagaggatctggatctgttgtgggatgccattatcaatatgtttgaaaacgatcattctgctgccagaggaaaaatggcagtccgcgctcttattgtgtttaagcacagcagggaattgggggattgtccggcatataaattatttgacgctgtagaagttaagaaaaatgacaatgtggagtatccaagaaaatatcaggattataccgttaccattcatgagaatgaaataccggattcggtagaagtgaaaaggatgatttaatggaatatacgcaggatgattatttaatgatttctgggatacagcattttaaattttgcaggaggcaatgggcactcattcatgtagagcagcagtgggcagaaaatgttcacacggttgtcggtgaattgatgcataaaaaggcgcatgatccatatcttactgaaaaaagaaaggatgttcttatcgttcgcgcactaccggtatcttcaagaattatgggagtaagcggagaaggtgatattgtagaatttcataaatgcaaagatgggataaaattatttggccatcgcggattgtattccgtatatccaattgaatataaaaaaggaaaaccaaaagaatccaatgaagataagttgcagcttgcagcgcaggcaatgtgtctggaagaaatgttttcaacagaaattccggaaggcgctatattttatggagaaacgaggagaagggagcaggtggaatttacagaggaacttcgcggtgaagtgagatcgatattcaaagaaatgcacgaatattataagaaaaattatactccgaaagtaaaaacaacgaaggcttgttcttcgtgttccttaaaggaaatatgccttccgaaattgggtaaagcaggttctgttaaatcgtatgttcatcggatgctggaggatgcagaatgagaaaattattgaatactttatatgtgacttccgaaaacagttatctgggattggacggagaaaatgtagttgtctatgatgacaaaaaagaaattgggcgagtgccattacataatcttgagggaattgtttcttttggatatcgcggaacaagtccggcgctgatgggagcatgtgcagataaaaatatttccttatgttatttaacaccgcagggaaagtttcttgcaagggttaccggaaaagtaaaaggaaatgtcatattaagagaacagcagttttcaagtaccaaagatgaaaaaatcagtctgggaatagcaaaaacatgtattcttggaaaggtatataatgcaagatgggttttggaacgggcgagcagggatcatccaatgcagattgatgtggaggctgtaaaaaatgcatcctcacaattaaaatcttttctggagtatattcaaaatgcaaaatcaatggatcagttacggggatatgagggagaagctgcaagtatatattttggcgtatttgatgaattgattttgcagcagaaaaaagattttgtatttcagggaagaaataaaaggccgccacttgataatgtaaatgcgatgttatcgtttgtttatacattacttacaaatcagattacgtctgcattggaaaccatcggacttgatccatacgttggatatatgcacacggatcgaccggggagagcatcgctttcgctggatttgattgaagaactgcgtgcagtgatggcggatcgttttgtgttgtcactaatcaataagaaaattgtgaacggaaaaaattttaccagaaaagaaaatggtgtagttttgatggacgcggatcttcgaaaaaaattgttgtcagaatggcaaaataagaaaaaggaaattattacacatccttacctgaaagaaaaaatggagtggggaatggttccgtatgttcaggctatgctgcttgcaagatttttaaggggcgatctggatggttatccggtatttctctggaaatgaggtgaaagaatgcttgttttaattacctatgatgtgaatacagagactgccgctggaaaaggccgtttgagaaaagttgcaaagcagtgtgtgaattacggaagacgggtccaaaattcagtgtttgaatgtatccttgatcatgcgcaatgtgtattattaaagtcgatattgacagatattattgatgaaagtgtggatagtttacgtttttattatctgggaaacaactatcagacgaaaattgaacatattggtgtggatcggggaattgcagcggatgaaactcttatattataataactatggtgcgagtaggaagtggacataatttttgggggatattcgcaccagaaaaattaaccaaaaacatctgaataacattaaaatggaagaaaaaattatctattttatgtgtcttttgatggatttgtcaatattatatgaaataacagaaatttattgtataatattgctgtcgctcccttcgtgggagcgtggattgaaataattaaatcacaccaatggtcacgcacataggctgtcgctcccttcgtgggagcgtggattgaaatattacacaatctataaagcatctgtgcgcgtggggtcgctcccttcgtgggagcgtggattgaaatctcaaccttagaaccacaacatccgttatcaatgtcgctcccttcgtgggagcgtggattgaaattggcggaaaagccggagaccagaccggacaggaaggtcgctcccttcgtgggagcgtggattgaaattttatgcataatgataatctcgtccccaacaatgtcgctcccttcgtgggagcgtggattgaaatatattgatgctgataatgtagttgacaatgcttgcgtcgctcccttcgtgggagcgtggattgaaatttaacaccatttgaggatgtacccgatggtgaaaagtcgctcccttcgtgggagcgtggattgaaatcttgattgcgtgaatcatcgctgattgatacacagtcgctcccttcgtgggagcgtggattgaaatttgcactgcgtggactatgaaaaatggtcgaagaagtcgctcccttcgtgggagcgtggattgaaatagttaacagtgccgatgatagcacaaagtttggcgtcgctcccttcgtgggagcgtggattgaaatcaataatcaatgattttctgctcgactgcttctcgtcgctcccttcgtgggagcgtggattgaaattatcttccaactgcgccacaaccttgtctacatcgtcgctcccttcgtgggagcgtggattgaaatcgcgcaaatatgcatcaaatgcagcgatgtctctcgtcgctcccttcgtgggagcgtggattgaaatcgcgcaaatatgcatcaaatgcagcgatgtctctcgtcgctcccttcgtgggagcgtggattgaaataattgcccacaaacaatactgatatgcgcggctttgtcgctcccttcgtgggagcgtggattgaaatgtaatcttccttgatcgttcgtttgaaatcggaagtcgctcccttcgtgggagcgtggattgaaataatttgcaacttgtctttttatcttccagctttgtcgctcccttcgtgggagcgtggattgaaatccttctttagtcctgtaaagtaaactttaatgcgtcgctcccttcgtgggagcgtggattgaaatatcaaaagcaccgttgcttaattgtggcggtgctgtcgctcccttcgtgggagcgtggattgaaatttgatagacggatcgccctttccggctttttttgtcgctcccttcgtgggagcgtggattgaaatctgcaacttttgacattattcttcacctcctgtgtcgctcccttcgtgggagcgtggattgaaattccaacgtgccattcggagtgcaagctttattttgtcgctcccttcgtgggagcgtggattgaaatatagtttgtttacggtttttggagattttgtaaggtcgctcccttcgtgggagcgtggattgaaatcttggaatccaaggaaaagtagtgcagtcggagtgtcgctcccttcgtgggagcgtggattgaaattggggaagagccggacattgttctcttccgtattgtcgctcccttcgtgggagcgtggattgaaatcgctaagcataatctggtctgcgctggcattaagtcgctcccttcgtgggagcgtggattgaaatatgaaatcttttatgtatcttgcatggtctcctagtcgctcccttcgtgggagcgtggattgaaatgtgctgtgaattttacacaattcgcttcgcacgctgtcgctcccttcgtgggagcgtggattgaaatagaggtgatatatgccaactaaaaaacccgtaatgtcgctcccttcgtgggagcgtggattgaaattgtgtttttccaacgtcaagcgaaattgccttctgtcgctcccttcgtgggagcgtggattgaaattttgtcaagccgtgcaagttctttcttccgctctggtcgctcccttcgtgggagcgtggattgaaattttacagtagtcagaagtttaagctgacagatgcgtcgctcccttcgtgggagcgtggattgaaattattgttccaagcggcaatataatgtttattctgtcgctcccttcgtgggagcgtggattgaaattgtcaaccggatagacatttttgccatctgccctgtcgctcccttcgtgggagcgtggattgaaatattcggggaaatgccgtttgtatgttttgagtggaagtcgctcccttcgtgggagcgtggattgaaatttataaatggtaacagctacgtcttatggggtacggtcgctcccttcgtgggagcgtggattgaaatattgtgatgcatctgcaatcctacaagaagtgtctgtcgctcccttcgtgggagcgtggattgaaatgtgacaagagtagtcagctttgtcttggtcaactgtcgctcccttcgtgggagcgtggattgaaatctttgaatagttattttgtctcaaatcctgatcgtcgctcccttcgtgggagcgtggattgaaattgtacataaccaatggcattctgcgtagcctgggtcgctcccttcgtgggagcgtggattgaaatatgctgatgatgttgtgcagtatgtgaaggattttgtcgctcccttcgtgggagcgtggattgaaatacattgtcgatcgatcttggcactccactgttctgtcgctcccttcgtgggagcgtggattgaaattgcatggctacacttagccgccaaacagtctgtacatcgctacctttgtgaaagcgtagattgcaataaaattgatcaaacagtcgagattgacttttgcattgatttctttgtaaaaatgtggattgagattccaatactttaattgcacattctacgaattaagagtaaaattttataaatagtgaaaaacgggatgaaacagggagaaaaaatgttaaaaaaattaacgcaacaggctacagatctgatattacattccatcgcctccggcgaagtcatgggtgctaatcttctcataacaaaaggaaatgaagaactggtctatgcacaggctggaatggcggaccgggaagcggaaaaaccaatcgaacggaatactattttccggttatattccatgacaaaaccgattacagcagtggcggcaatgattctgatggaaagaggaatgcttgatctgtatgagccggtagcggatatccttccggtatttgcacaccagaaagtggagcgagacggaaaattgtatacaccggagaggccgatactgatgcatgatcttttggcgatgacttccgggctggtatatccggaggaacagaccatgggtggacgtgcagtcacaaaagtgtttgaggaagcatgtgcgcgtctggaaagtgatcacccggtgagcacacaggaaatggcagaaaaaattgcggcatgtccactggtatttgcgcctgggacaagctggcagtatggaacatctgcagatataatgggcgcagccattgagaagatagtgggagaaccactgtacgcgtttatgagaaaggaaatcttcgaaccattggagatggaagataccggattttttgtgccggaagaaaagagaaaacgtctggctgcaacttacgcatcggttttgcaaaaggaaaagagaacgatggagcggtatgaaggaaatcatctggctattttaaacgatatgagcggagagccggcatttgtttcgggaggagccggactggtatcgacattggatgattatctgcattttgcgcggatgctgctgcagggtggaatctggaacgggcagcgtattctgcagaaaaaaacggtggaatatctgacgcatggaagtttgttggcaaatcagcagcaggcaatgcagcagtggatcggactggaagggtatacctatgcaaattttatgcggagatgtgtggcacctgaattgcagcagggaatctgtgtaaagggagaatatggctgggatggctggctgggcgcatattttgcaaatctgccggaacaggatatcacgatccttatgggagcacagaaaaaagatgcaggcacgttttccctgacacgccggttgcgaaacctgtgtctttcaaacattctgtaaattacaggagggtaatacatttggaacagaaaaacatgcttccgggactgacgcgggaggccgaagaacaaaaactgcaggagattatcgggattgcacagcaaaatcttgaacgcgccagagcagatatccggaaagtgaacgaggatctggaagacctgctggacgtgtatgaggcacaggataaggaaggcctggcgttgtggaataatgcaaccgcgcgtctgaaggaaaatgagtatgatctggtgcgttatgagaaagcgcgcaggaaaccgtattttggacgaattgatttcaaagatccgaatgtaaaaggggacgagtcttactatatcggaagagtgggaattgcaaaaaataactcggaaccggtcgtattggactggagagcaccgattgcatcggtatattatgagagtggtctggggccatgtcagtataccgtcagttcggagggaacctttacgattgacctgaaacggaaacgcacgtatgagattgaaaatgatcatctgaaagatttttttgattccgatgtggtggcaaatgatgaacttctgacaaagtatctggcgaaaaacaagaaggcggtgctcggtgagatcattgcaacgattcagaaagaacagaatctgattatccggcgttcgccaaagaccaatatcattgtacagggtgtagccggttcgggaaagacaaccgtcgccatgcaccgtatttcctatattttatacaattacagcgatgatttccggccggaagatttctatattatagggagcaaccggatactcttgaattacattacgggggtattgccggaactggatgtgtatggcatccgacagatgacgatggaacagctgttcatccgcctgttgtatgaggattgggatgaacggaaatatcgttttcacctcctggaaaaagatgatgaaaagaatgcgcagaaaggaaaccgtgagtggtttcatgatctggaattatattgtgcagcttatgaacagagggaaatttcacacgaggaagtttatctggaaaacacaaagacacttctggtcgggcatgtgctgatcaatacttatctgcgggaacatcccgatctttccatgcagagcaaaattcttatgctcaacgaggttttatattccaaatacgaaaacgaagttctgggaaaacaaatatcctatccggcaaaagtaaaaaaggcactggataagaaatatgcttctttttttggagatggaaaatggaagacatctatttacgatttttaccgggaattcttacaggtgcaggcagttgccgggaaagaagtagatataccagaaacttcttttgatgtatacgatcttgcagcgcttgcctatatttacaagcggatcaaggaaactgatccggtgcgggaggccagtcatgtggtcatcgatgaggcacaggattttggaatgatggcatattgctgtctgcactattgtctgcggggatgcacatacacgatcatgggggatacttcccagaacatacatttccggtatgggctaaatgactgggaggaattgcggaaactggtgctgaccggtacgtatgatgcgtttgggctgttgcggaaaagttaccggaatacggtggaaatttccaaatttgcaaatgatattttgcggcatggagattttgctgtgtatccggtggaaccgattatccggcatggagcagccgtgcgggtggagaaacagccggatgcaacagcgcttttagaagagacggtacacacgatccggaagtggcagcaagatggatatgaaacgattgcggtgatctgtcgtgaggaaaaagaggcagcagagctggcggaacagttgaaatcttatatggagattgtggactgtaacccggggactacggaatttggagacggtgttatggtgctttcggttgcctacacgaaaggactggagtttgatgcggttcttttgtatgatccgacgcagaaaaaatatccggcagataacggacatgtgaaacttttgtatgttgcggcaacccgcgcgctgcatgagcttgtggtgttgtatcacggaaatctgagcagaattctgacagatccggtttcaaaagagaaaaagcagaaagtgtttgcagcagaaacactgaccaaggcaaaggaatatgaaaagaaaacctttacgcaaaaagaaatagagcagcagcgacggacggaggcggataaggaacgcaatgcgcgaagttatatcggtccggaacggatcgaggtgtctgcaccgaaggaagaggaacctgacatccatccagtttcagagaagtcagtacccaagaaagagaaacctgtcatccatccgggttcggagaagtcagtacccgagaaagagaaatctgtcatccatccggtttcaaaggtgtcgaaggccccggagattgcgcagatcaatccgtctccttatgcatttggggatctgccggataaccggttgctaccggtacgtggacattcccgcatgaattatacggtgaaatgggccaaaaaaacgaaaaagcatatagacattgcaagtatggcaggaattcttcggctgacaccgattacacccgaggtgataagggtaagtttcgtcaaaggtgtgacgacagaaatcaaggatacctactggaaaccggaggcaacggatgttttttcgtggagtgtcagagagtcaaagacggcattaaaagtttccacggaaaaagtcagtgctgtgattgataaaaaaacaggtgccatacaatttgaaacagcagatgggacggtactgttaaaggaacgctccgtggaaccgcgcctgattatggatcagcagacctgggaattttttgaatgggattcttcggaaaagattaatgcaaagggaattctttctacggatctgctcgtgctgcgtgcaaaggcaaagtatatttcttttggaggaaagcctatgcggatgcctcttgttttatccaggaaggggtatgggcttgggatagcggctaaagaaaccgttttgctctgtaatatcaaaacctatgggccttacatcagtacactgggcgaggatcagatcgactattattttatttacggggagacgaatgaagaaacaatttccatgtacaaaaaactaactttatagacttgttcttttccatattttcttattgaaaaactttctcttttagtaatttacgtgtataattaagaaaaattatcaataacacaaaagaaagaatgcaaaggataagacaatatgacattaaaagaattggaaatcgggaaaaatgccgttataaaaacggttggcggcgagggtgcgctacgccagcatttcctggatatgggagtgattccgggagcggaagtgacggtgattaagtttgctccaatgggcgacccgatggaactgcagatccatgggtatgagctgactcttcggttggcagatgcagatcagattacaattgagcagatttcttcccgtaccagaaagcatgaaggagccagaaacattaatcagtcggttcatccgggactgggcgaagaaggaaagtatcatgtaaaaggggatggaaaccctttgccggaaaagacgaggcttacatatgcgctggtgggaaatcagaattgtggaaagacgacgctgtttaaccagctgaccggttcaaaccagcatatcggaaactttccgggggttacggttgaccgcaaggatggaccgatcaaaggatacccagacactctggtgacagatctgccgggaatctattcgatgtccccttacagcagtgaggagattgtttcaagaaattttgtgctggaggataaaccaaaggcgatcatcaatattatagatgcaaccaatatcgagcggaatctgtatctgacgatgcagctgctggaaatggatatcccgatggttgtggcactcaatatgatggatgagatgaccggaaattcaggatcggtggatgtaaacgggatggaagcgatgctgggtgtgccggtggtcccgatttctgctgcaaaaaatgagggagtggatgaactggtaaggcatgcactgcatatcgcaaaatatcaggagcggccgggacgacaggatttctgtagtgaaaatgagtttggtggagccgtgcaccgctgtattcatgcagtcagccatctgatcgaggatcacgcagagcatgcgggaattcctctgcgttttgcagcttctaagatcattgaaggggatcatctgattctgcagaaattggaactggacgagaatgagcacgaagcaattgaacatctgattgtacagatggaaaaagagcgtgggctcgatcgcagtgcggcgattgcggatatgcgttttaatttcatcgaaaaggtgtgcgagaaaacggtagtaaagccgaaggcaagccgggagcgcatccgcagtgagaaaattgatcggattctgaccggaaaatatacagcaattccatgttttatcggtattatgctgttggtgttcttccttacgttccatgtgatcggcgcttttttacagaacctgcttgccatggggattgacgcactgtccaatgtgacagaccgtgcgctgacggcagcgggagtcaatgaagtgcttcacggactgatcattgacggtatttttgccggagtcggaagtgtactgagtttcctgccaattatcgtaacattatttttctttctgtcattgatggaagacagtggttacattgcgcgagttgcattttttatggataaacttctgcgaaaaatcggactttccggacgaagcattgtaccgatgctcatcggatttggatgtacagttccggcggtgatgtcgacccgcacgctgccgagtgagagagaccggaagatgacgattttgctgactccgtttatgagctgttcggcaaaactgccgatttatgcattttttaccagcgcatttttcccggagtatggagcattcgtgatgtgtgctttgtatctgaccggaattatgattggaatcctggttgcgttgttgtatcggaaaacactgttccgtggagatgcggttccgtttgtcatggagctgccaaattatcgtctgccggggctgaaaaatgttatgcagcttttgtgggagaaagcaaaagatttcctgcagaaagcatttaccgttatttttgtagcaacgatctgtatctggttcttacagaaatttgatttgcattttaatctggtggcagattctaaagacagtattcttgcgatgatttcaaactgcctggttccaatttttgcaccgcttggactgggagactggaggatctgtacttcattgatcagcggcgttatggcaaaggagagcgtgatctcaactctggaaattttatttggaggagcagtaaaggatgcattgacaccggtagcggcagcttcacttctggtatttagtctgttgtacacgccgtgtattgcagcaattgcttccattcgccgggaacttggacgaaaatgggcagttggcatggtgatctggcagtgtatgatcgcctgggtggcagcatttgcggtaaggtggctgatggttttatttatgagataatgaaaatagagcagaaagtacttgaaggaatcggaaagatagaataaaataataacaaaaaaggattatttatttatgctcagacaaatgtggaaaaagagggtttgttttgttctggctgtgattctggcagtaattgctgtgacaccaatggaaatggagcacacagatgcagcaatggtacattcggtaacagcattgatgacgggaaatctggtaaacaagtccaatgcggacaagctgacttacagacagctggagacaagcgcctatgagagaaaactgatttcaaaaagtgtgtataattacacgatgcagcaggtcccggcattgtatgagggcaggaacgtcattaatgtgtccggtatgaccggaaaagcaaataccagttatgtggatgatgatggtgttggtgaaaatgtctcgtttgtaaaatttcaatgtagaaagagcggtaaataccagtttacggaaagtgattttaagggaaaatccaagaatgaagtgatctataatgataacaattatctcatgtttctgccaaaagagttaaaaagcgggtatgagatttatgacccatggaacagtacctactatcagtttctttccagaacttttgcaagtggttatggcaaagtatggtatgatgtcaacgcatcgaaaaaacttacgagaagtgcgaagcgtgcaataaaaaattcggcagggtatacaagcgctatccagagggaactgcagaagaaaaaagacagtatttccagatacagtatggaatctgaaaaaaatacgtatcgcttaaagaaaggaaatacatatctgcttgtaatttttacgccggattccttccgcttccggaaaaaaataacaaacggaaacaattattataaggaacagtatctttccgatattccatggtcgttcgatctgaaaattacttatatggatgaaaaagcagattagcaaaattaccctattgtattagaaatcagaacgtggtacaatgcataagaatagaaaaaagcattgacggaacaagtagtgaaattgaaacatacagagagaacggtagatggtgtgagccgtttatggaaagatttcatgaagaccactcctgagctgtgcgcgaaagaagcgtcaccgtgtagctgcgttataagccaaagagtaaaagaattaaggtggaaccgtgtataaagcacccttagatatgtcatgcatatccgaggtgcttttttatttccataccaaaagaaggagagttaacgtaaaatggtaaactttaaggaaaatgaagaattaaaaacactgaatcattcctgtgcacatctgatggcacaggcaatcaagcatctgtacccacaggcaaaattctgggttggaccggttgttgcagagggattttactatgatgtagatcttggggaagatgtaatccgtgatgaggatatcgaaaagatcgaaaaagagatgaaaaagattgcaaaatccggaaagaaaatcatgcgacgtgaagtttctaaggcagaggctatggaaatgttccagaatgatgagtataaactggatctgatctccgatctggaagatggaaatattaccgtatatgatcagggcgattttacggatctgtgccgtggaccgcacgtagacaatgtaaaactttgcagaaacttcaagctgatccgtcactctggtgcatactggaaaggtgacagcaaaaacaaagtgctgcagagaatttatggtgtatgtttcccgaccgcagaggagctggaggcacaccttaagcttttagaggaagcaaaggaaagagatcacagaaaaatcggaaaggacatgaacctgtttatggttgatgatctggttggccgtggacttccgatgttccttccgaagggatatgtgatctggcaggagctggagaattatatcaagaacaaggaaagaaagctgggctatctgcatgttatgactccttgtgtcggtaccgtaaatctgtacaagacatccggtcactgggatcactacaaagaaaacatgttcccaccaatggagatggagggagagtctttcgttcttcgtccgatgaactgcccgcatcatatgatgatctatgcaaacagaagacattcctataaggatctgccgatccgtatcggtgagatcgcacatgatttccgttacgaatccagcggaacgttaaagggtatcgagcgaggcagacatttttgtcagaacgatgcgcatctgtttgtaacaccggagcagattgaggatgagtttaccaaggttgtagacttgatttttagtacctacaaggatttcggaattaccaattaccgttgtgtactgtctctgcgtgatccggcaaacaaagaaaagtatcatgatgatgatgctatgtggaacaaggcagaggatgcactccgcacggtattgaatgatctgaaaattgattatacagaggaaattggagaggctgctttctatggaccaaagctggatgtaaacgtacagcctgcagtcggcaatgagatcacactttctacctgccagcttgatttctgtctcccggcaaaattcaatctgtcttatgtagaccgtgatggtgagaagaagacaccggttgttctgcaccgtgcaatccttggttccctcgatcgtttcatggcatatattcttgaggagaccaagggaaatctaccgacatggctggctccggttcaggttcgtgtgatgccggttaagacagacaacgaggaactgactgcttatgcaaaggaaatctgcgatgcattagaggcaaaggatgtccgtgtagaactcgatgacagatccgagaagcttggctatcgtatgcgtgaaggacaggtgcagaaggtgccgtatcttctggttgtcggcttcaatgagaaagaagacagaaccgtatccttccgtctgcatggagaaaaagataccacagttcttccactggatgagtttgtggagaagcttgagaatgagatcaaaaataagttgagaactcatatcggggctcaaaaataaataaaagccgatttgaaacagtaaaaaatgcgcgcagcaaaaagtggtgccccccttttgctgcgcgcttttttgcaggaaaatatatttttactttcatgttagaaagtcgttgtattctgttcagaaacttccaacttccggatcagctggaattcatgtataaccattgccagtccgactgcaaaagataacacatccgcaaccggactcgcataaagaattcccttaattccccagaaacgcgggaaaagcaaaagcagaggaagcaggaataaaatctgtcttgtcagagaaagaaacgttcccttatatgcttttccgatcgaactgaaaaacgtcgaggaaatcggctgcataaaattaagccatgtaaacagcaggaaaatccggaaatagtttacaccgaaatcaaaatattctttgcttccgctgccaaacagaccgaggatctgtcgcggaaaaatctgaaacagcagaaaggatacaatggatacaatggcaccgaccgtaatcgccagacgatacgattcctttacccggttgtactgttttgcaccgtagttaaaactctggatcggctggctgccctgtgacaggccgataatcacggaaaagtaaagctggttgactttcatgacaattccggaacaggcaatcggaattgactctccgtaaacggactgtgcaccgtaatgctttagcaggttgttcatcgtaatctgcacgatcatcatggcaacctggttgatggcagaagccatgccaagtgagcagatctgtgccagatgggaagcattcggccggaaatgcttggagtgcagggttactgtgcggtagtgtgacagatagcagaccgcaataatcgcagagatgacctgaccgatcacggttgccgctgcagcaccgtacatgccccagtggaatcccagaacaaacacggcatccaatacaatgttgatgatggcgccggaaatgtttacaaacatcgccatctttgggctgccgtctgcacggattaagtgtccgcttccgatcgtaagaattaaaaaaggaaaaccgatcgccgtcacacggacgtattgccgggcaagcgggagaacatctgcaggggaaccaaatccgaccagcagaggattcaaaaataattcggttatggcaaaaagaaggatgccaacggtaagaagcattgtgatggcgtttccgacaaaatagggagctttttcttttttgccggcacccatgtgaaggttgaagcttgccgcaccgccgattccaaacagaagtccaagtcctgtgcacatcatggcaagtgggaatgcaatgttggtagcggcattgccgagtgtgccgaccgcatttccgataaaaagctggtctgcaatgttgtataccgcactgacaagcatggcgataatgctcggtacggaaaagcgcagaatcagcgaagaaattttgtccacggcaagtggattttgttgttctgaagtcatatgtttcgccctttcttatgttaatatctgtatttgcttttatatggcaaacttatattattatagcttttttcctgttttttttcaatgaagccgggcagcagaaaaataaaatggaaatttttgtatttctgaaacttttatgtgtgatgaatggtctaatagatagaaacaaaaaaggaggaaaataaaatgagtaaactgagtagtgtattaaaaaagacaggtattgcagtagctgctgcggcaatgctggtgacaatgggagcaggaacggtggttacacaggcaaaaacaagtctgccggtttataaagtatcgctggcaaagaagtataccaacaaccagaagggcaaacagatggaagccagtgtaaagattccgaaagtgaaaattacaggtacagacggaaaagtcatgaaaagcgaaagtgaaaaactgaatgctgccatttccagttatcagaacaaatttatcaaagattataaaaaagatgtggcagccataaagaagggagagaagggaaatgagagccttacttccgggtataaggttgtaaccgacaacgacaagctgttttgcctgcggattgatacggtaattgctatgggcggctcccagagttatgcaaagattttcagtgtggataaaaaatccggaaaacaaatcactctgaaaaatctgttcaaaaaaggaagcggctatattgaccggatttccgacaatatcaaagaacagatgcgggcacagatgaaagagaatgcagatgttacctattttgtggacgatgaaaacaataagttcaatttcaagtccatcagcaataagacgaatttctatgtcaatgagaagggaaaacttacccttgtatttgataagtatgaagtagcaccgggatatatgggaatggtcgaattttccattccgacaggtgagattgtagatatggttacaaacggatatctgaaataaaaggcatatagaaaaaatggctctgtgggcaaattccacagagtcattttttctatttgggctgacttgaaaaagtaaattccagtgcaggggtaaattccactacgctttaaaattctttgattttttagaattgtgggaggctaaatccttataaaactgctataattagattaactttccataaaacatcttactttcaggcatggcaaacaagcctctgaatagtttctgtgcgaaactaaattccacaggccgcattcaaaaaatgtgaattgttaagttccagcctgacagcagatttttatgctaagttagtggttaaagcgtatcagcttaggcgtcagattgacctcatcgggtggaataggcctaagctgaagtgcttttaagatgtctataccatagttttcaagtgctacatcatatggtgttcgaccaccaaggctttctcttggggttgaatttatgtggtctacgatagttcttaaatcccactgggtgagatattcaaagctggtctttttaggaagaatcattcgaagcatggtatgtgcctgttcgatgccgcctttttgaccgcttctcatcggatcacagtaatagatgcttgaccgcataatgccattaatgccgttttcgagagactccggatctccgaattcggatccgcgatccgtaagaatcgtgttgaataaggttaaaaaatcatatgtgccaagctggtgttccaacttgttaaaaacaagttttacggcacctttggtgcatctgttcataatgaatgcaagaaacagtttttcacgggttaagaagaatgtcaggatgacacgctttgagtcctgtgatgaatgaacggtatccatttcagcaaaatggtcaagttcaagggcttgaaaatcagaaaacatacgtctgataaaaacggatctgtctttgatctgggtcttgtgtactttgcggggtttgaattttacctgacgtttcagatcgatgtttcttgcggacaggattcctttatcaaggtaagaatacagagttctcacggacatatcgagttctggatgattcgttataatctgatatggagactgtccctgaaaaatcaggggcgtgatgaccatatctttctgatgcagttcgtgtctggtcatgtttataccggccctggactgtgagagacattctttgtatttgcggtcagcaaaaatagcatcatagcggtatttgtgggcaatcgtgcagtgattgattgcttttggacaaccattacacacataaggtgctttatcgagtcggttacatcgttctttgacaaagtctggacatgtctggttgcaggttggacaggtggtacatttgacaccgcagagaatgatcttgccacaggcattgacttttttgcaatgatatctgtggacgcaaaagttatgtgcattgttaaaacagcctttgtgataccagtcgctgagcctgtgcagcctgatttcttttgagattgttgttggatctttacaaagatatcttgcaatgtccttaaaagaatagccagcgtttagggatttttcaatgtatttgcgatcttcgagagtaagatgtttttgattaccgggaatatatttgctcatgctagttctccttctactgctgtcagaaggccaacatgagcataccatttatgatatgaaagattaaactccacttgtgcagaagagaattccactgtataaatggatggcggaattaaactttgcaattttcatttttctatttggtgcaaaggaagaggatgcaatttctgatttttatggtatactgtctgtagaaaataaaatgacatgagagtatacctatgaaaaacaggacaggccataggcttaaatatgttagaatatgcaggtgtaggggagtgaagcatgcagttcgtgttgactaatttgtataacagctgataaaatgattgggaaaattacggcatctgattcattcatctgcagagcatttggtgaaaaagatacgacggtaattgtgttgaacaattttaatataaatgaataaaaactctgacggcaaggatgatccgagcaggaatagttaagaaataaggatttacagaaccatctttctgacagattgcccgaaagatggttttttgcgttgaaaataacaggaggatagcatgttaaaggtagcagtatacggaaagggcggtattggaaaatccacagtgacttccaatcttgcagcagcttttgcaaatatgggaaaacgtgtcattcagatcggatgcgatccgaaagcggattccaccattaatttacttggtggtgagccacttcgtccggtaatgaattatatgagggaagaggacgaggagccggatgagctggcgcagatttcaaaggaaggctatggaggaatcctctgcattgagacgggcggaccgacaccgggacttggctgtgcggggcgtggaattattgcgacttttcagcttcttgaagacatggaactattcgaacattataaacccgatgtggttttgtatgatgtattaggtgatgttgtgtgcggtggatttgcagcaccgattcgtgagggatatgcggataaggttctgatcgttacatccggtgaaaaaatggcactgtatgctgccaacaatatttccagtgcagtcagaaattttgaggatcgcagttatgcccgggtatttggcatcgtgttaaatcacagaaatgtggaaaatgagaaagaaaaagtacaggcattttcagaaaagatcggggtgccgattgtgggagaagtgccgcgaagtaatgaaattattcactgggaagagcagggaaagactgtgattgaaggagatccggcctctgaaatcagcagatgtttctttgatcttgccacattgttatggaaagaagaggaaaacgcatgagacaggaagcatatttttgtacggtaaaagagctggatgagcttggaaaaaataacattcccagacagcttatttcccatacacatctgatctacagttcccctgcaacgctggcattcaattctccgggagcagaaggatttggtgtcaaacgtgcaggtctggcggttccggattctgttatgttgatcgtgtctccgggatgctgtggccgcaatacctcggtgcttagttcgatgcgggcctatcaggaccgtttttattatctgttgatggatgagacggatattgtgaccggaaggcacctgaaaaagatccctaaggcagtagcggaaatatgcgaaggacttaagaaaaagccgtctgttgtgatgatatgtattacctgtgtggatgcgctgcttggcacggatatggagcgtgtctgtcacaaggcagaggaatatgcaggggttccggtaagaccatgttatatgtatgcactgaccagagagggcagaaaaccaccgatggtgcatgtgcggcagtccgtttattcgttgctggaaccgaaaaagaaaaaaggaaacgtggtgaatttactgggatatttttcaccgcttacggatgactgtgagctgtatgatctgcttcatggggcaggagtaaaaacaatccatgagatttccaggtgcaaggattatgcacagtatcagaccatgtcggaagcaaattttaatctggtactgcatccggaagcgcgctttgcggcagaggattttcatgaccggctgaaaattccatatatcgagctgcgcagattatatcagatcgataaaattgccagtcagtatcgtgcttttgccgctgcactgggtgtggaatttgaggatgaaataccgcgtaaggcagcagaggaggcggtagaaaaattccgggaaatacatccggatgcagtctttgccgtcggagaatggatgaacggagatccgttcgaactggcacttgcattggtacactatggatttcgtgtgtcggagatttatggaacattatccggtgaaaactttgtctatgtaaaacaactggcaaaaatcagtccggatacgaaagttttttccaatctggaaccgaccatgctgtattatgacaaaagtcagtccggcgtcaatatgaccataggaaaagatgccggctattatcataaagaatgttccaatgtgctctggaatgaagaacggcagccatacggttatgccggtgtgcgcagactgtttgaggcattggcggaggtataacacaatgagaggactgagaaaatatctgacaccatttgcaccggatcagtcaggtgcggtgtctgtattatatgaatttggcggtattatcgtcatttgcgatgccggtggttgtaccggaaatatctgtggatttgatgagccgcggtggtttgagagcaaaagcgcactgtttagtgcagggcttcgcgatatggatgcaattctcggccgtgatgacaggctggtggcaaagcttgcagatgccgtgacaaaactggatgcaaagtttgcagcgattatcgggacgccggttccggccgttatcggaacggattaccatgccttaaagcgtatgacggagaaaaaagtggatcttccgattctgactgtggatacggatggaatggaattgtatgacaagggggaagaaaaagcctggaaggaactgtttttggtatttgcaggtgaaaaagaagacgtgattttgggcagaatcgggatacttggcatgacaccacaggatatcagtgatctgcgtgcagcagaccgtatccgggagcgttttgcggcagaaggaaaaactgctgtctgctttggaatgggaaatggacttgatgatgtaaaatcggtttccaatgtggaaaaaaatatcgtggtatcgccggccgctttagaggcagcgaaatatctggaacgaacatatggaacaccgtacgagacaggctatccgctggtggatgaactggtttacgatatggattatcatgggaaaaaggtacttattgtacagcagcaggtgatcggatctgcaatccgggaagagatacaaaaaaaagcaaaggatgcacaggtgacagttgcaagctggtttatgataaagccagagctttgcagtgacacagatctgcatctgcgggatgaagaagattatataaggctggtggaaaacatggaatatgatgtgatttacgcggatccatgtatgaagcgtatgacaccggaatttgacggaatctttgtggatacgatacattttgcggtgtcggggcatcttgcagagatgagataacagttgccggttgtcttgtaagatgtgacccgcaataagggcgtgtacgattggagaaaagtgtgtataagaatgagatgacctggcgcatccgggtatacggtatcgttcagggtgttggtttccggccaacggtaagccgccatgcgacaaaccatggaatttacggaactgtttgcaataaaggaccctatgtggaaatttatgcacaggggacaaaagaacagatcgatggatttttaaacagtctgaaagaacatccaccgaagcgtgcggctgttttgaagataaatacagaggatatcaccgcagatacaacagaacagtttgaacattttgacattatcgaaagtgaaaaaacaaaaggggaaatctttatttccccggatattgcaatctgcgatgagtgcaaggaagaaatgtttgacccgaaagacagacggtatctgcatccgtttatcaactgcacctgctgtggaccaaggcttacgattctggatgctctgccgtatgacagggaacgcacaagtatgaaagagtttctgatgtgcccggactgtgcaaaagaatacacggatgagaaaaccaggcggtatgacgcgcagccggtgtgctgcaaccaatgtggaccacaggtgtatctgatcggcagacccgagcggggacgtgccgcaattacatatacacgccggcttattcgtgaaggcaaaattgtagcaatcaagggaatcggagggtttcatctgtgctgtgatgctacaaatgaagaagtggtctgccgtcttagaacattaaaaaaccgcccggccaagccctttgcagttatggcaaaagatgaatcggttgtaaaacgggaatgtgtggtgacgccggagcaggaggcgattcttaccggacatcagaaaccgattctgttactggacagacgaagcgatggcgggctggcatcttcggtggcaccgaacaatccaaaagttggtgtgatgcttccatatgcaccggtgcagttattgatttttcagtatgatgatggtatcgagatgccggatcttctggtgatgaccagtggaaatacttccggtgcaccgatctgtcgtgaggatgaggaagctgttgccgaattatcccacttgtgtgatgcgatgctgtcacataaccgcaaaatcaggatacgggcagatgatacggtgatggatttttacagaaatgaaccgtacatgatccggcgttccagaggctatgcaccgctgccgtttatgacaaaagcagactggaaaggacaggtgctcgcggttggcggggaattgaaaaataccttttgcataggtgtggacaacaggttttatccgtcaccatatgtgggagatctggaggacttaagaacggtaaaggcattgcaggagacaatacaccggtttcagacattgctggaagtaaagccacaggctgtggtctgtgatctgcacccaaaatacaattctacggttgtagcggaagaacttggatatccggtgataagagtgcagcatcattatgcacacatattatcgtgtatgacagaaaatgactgtcatgatccggtcatcggagtcgcttttgacggaaccggatatggaacggatggcacgatctggggcggagagatcctgctggcggattatgggaattttacaagattcggaagtattaccccgtttttacagatggggggcgatgcttctgcaaaagagggctggcgtattgcggtctctatgatttacggatatacgaaagatcgcaaaagggcatgggagatcatggaaacactgggtctttgcagcgaacaggaaagcagggtacagttcaccatggcagaccggaagatcaatgcggtggcttcaaccagtgcaggacggctttttgatgccgtcagtgcgatactcgggatcaggcgcaggtcaggatttgaaggggaagcatcgacggcattgcagtttgcagcagaggcatacgagcagcagaacctctcaaatatctcacaggagcaaaaggaaaataaggatatactgctgcatgaaacaaaagagcgtttcgttttaaatacacagatgttggtgcagcagattacagaagcaaaaatgcggggcgaagacaccgggatgctggcatatcggtttcatcaggtactggcagaaatgattacagctgcctgtatcaaagcaaaagaaagcagtggcagggataaagttgccttaagcggtggcgtattccaaaaccggttactgctgcgtctgacagaagaacgactgttacaggaaggattcgaagtgctgcggcaccgtatgattccgccgaatgacggaggaattgcaatcggacaggcagcatatgggatgtatcaattacagaaataggaggataaaaagatgtgtgtaggtttatcagctaaggtagtaaaaatcagtaatggcacggcggtcattgatgcaggcggtgccaaaagagaggtttcttcccagcttctggaagatctggagccgggagattatgttatggtgcatgcaggtgtagcaattgcaaaaatcaccgatgaggacgacagtgaaaccgagcagctcatggaggaatttttataatgaaaacagccagagagatcattgaaaattatgatggcccagatgtgcggatcatggaagtgtgcggtacgcacacacatgagattttccggctgggaatccgtaaactgctgccaaaacaggtagaattgatttccggaccgggatgtccggtatgtgtaacaccggttagttttatagatgaagctatttatctggcattggaaaaaggagttacaatctgtacatttggtgatctggtgcgagtgccgggaaccaatatgagccttgcgggagccagagaacagggagcgaaaatccatgttgtgtattctccggcagatgccgaaaaatatgccggagaacatccggatgagcaggtgacatttctgtcggtcggatttgagacaacgacaccggcaggatgtctttccgtaaaggcggcaagagaagatggactggataattactctatattggtggcaaacaaaaccatgcctcaggcgtatgaggcattaaaggacagtgcagatgtatttttatatccgggacatgtcaatgccattacgggaacacgtctttgcgaagctctgaccgaagaaggggtcagcggtgttgtggcaggatttacggcaaaagaactgatgacagcactggcggttgcgctggtaaaattccaggaaggaaagccattttttgtaaactgctatccgcgagtggtgacacaggatggaagcagggaggcacagctgcttgtagatgagatgatggaagcctgtgactgcgaatggagagggctgggtgttattccgaaatccggcatgaaattaagacaggagtggcaggagttcgatgcacgtctcaaatatcagatgccgaaaattgaaggaaaaccaaatccggcctgccgctgtggcgatgtacttcaggggaaatgcaaaccatccgattgtaaagtattcggaaaaggctgtacaccgcagcatccgatcggcgcctgcatggtgtccggtgagggagcctgctctgcatattatcagtattcataagaaagaaggaaaaaacatcatggaaaataaaacagtaacgatggcacatggtgccggtggaaagcagacatccgaattgattgatcaggtgtttaaggcacattttgtaaacaatgatctgacggcagatgatgcagcggtattagttccgccggcaggaagaatggcagtatctacagatgggtttattgtatctccggcattttttccggggggaaatatcggcaaactgtctatctgcggaacggtaaatgatcttgcctgtatgggtgcaaaaccgctttatcttacctgcgcttttgtaattgaagagggatttccaatggaaaaactcgaagaaatcgcagctgccatggaaaaaacagcaaaagaggccggagtacatattgtatcgggagatacaaaggttgccggaaaaggacaggtggatggaatttttatcaccacgaccggaatgggggagatcgaagaaggagtgaccgtcggcggagaactggcaaagcccggagatgcaatcatcgtaaccggtgatatcggacggcacggatgtacgatcctgttagagcgggaagattttggcatcgatgcggatgtgaccagtgactgtgcacctttgtggaagaccgtaaaggcagtcatggataccacacacaacctgcatgtgatacgtgatgcgaccagaggcggcgtcggaacagtcctgtatgagattgcaggtcagagcagcgtaggcatccgtttaaatgcagaggctgttccggtacggccggaagtaaaaggagtctgcgggatgcttggacttgagcctttatatctggcatgcgaaggaagacttgtcatcatggcaccaaaggaagaggcagagggcattgtagaaacattgaaaaaatgcccatattccgcagatgcagctattattggtgaagtgatcgcagaggaaccgggaagagttataatggagacggaaatcggcacacaggcactgcttccacagccggggggagagcttttaccaagaatctgttaacaggaggagtcagggcatggaaaccagagtggcagttatttcaattattgtagaacaggaggatgccattgaagaattaaatatccttcttcatgaagcacgtcagtacattgtaggcagaatgggcataccataccgcgcaaaaggaatcagcatcataagcattgtcattgatgcaccacaggacacgatcagtgcactttccggaaaaatcggacatttaaaaggcgtattcgcaaagactgcatattcgaatgtcattactccggcagaagggggaacacaggattgatcaggatagcagtatatggaaaaggcggaatcggaaaatccactaccgtttcaaatgtagcggctgcattggcagaaatggggcttaaggtgatgcagatcggatgcgatccgaaagcagattctaccatattgctccgtcatggagaggctgtgccggccgtgctcgacttatataatgagaaaaagcaggcgttgcagctggaggatatgatacgcattgggtataacggtgttatctgtgtggaggccggtggaccgacaccggggcttggctgtgccggccgtggtatcatcacggcactggaaaagttaaaagagcttggcgcatatgatgtatacaaaccggatgtggttttatatgatgtactcggagatgtggtatgcggtggattttccatgccgatgcggggcggttatgcggacaaaatatttattattacctccggagaaaacatggcaattcatgcagctgcaaatattgccatggcagtggaaaattttaaaaaccgtggatatgccgggcttggcggactcattttaaatcgcagggatgtcccgcgggaagaggaaaaagtggcagaactggcagacgattttcacacagctgttattggtacactatcacacagcgggcaggtggcactggcagaggagcagaaaaaaacattgatggagtgttatccaacaggtgaaatggcagacgaataccgtgcgcttgccatgcagatgtatcgcatatgcggtggcattctggaagcgaaaagcgataaggtaaggtccggatatatacaggaggaagcgtaatgttacgtcgtgtgggggaaaacgttgattcgaaagatgctgtggtaaaaataaaagatgcctcatttccaacaccatttgtttcggcactggagtataattcgccggtgcatggcaactggaatattgtgcatacgggaatgcaggttccggaatctatccagatctatgtctgtgcggataactgtatgcgtggtgttgtactgactgcggcagaaatgaatgcagcagaccgtttttcttttgttcttgtggaggagcagaatctgctaagcggcaatctggaggatattaccatcgagggtgtgacagatgtgttgaataaacgggaggaccatcctgaggcggttctgctttttaccgtttgtctgcatcattttgtgggaagtaatctgaactatatttacagggaactagagcatcgttttcctgacatctgctttatccgctgttatatggacccgattatgcaaaaacatggactgacaccggaccagaagctgcggaaagcaatgtatgatcctcttttgggctgtgagccggacgctaaaacagtatctgtctttggcagtgattttgttctggatgagaacagtgatattaagcgtctgttaaaacgatatgattataaggtgctggaactgcccggatgtaaaacctggcaggaactgttggatatgagcaggggatgcctgtttatcgactgctatccggctggaaaatacgggatggaggcacaggcaggccgcctgggacgaaaatctctgtatctgcccggcagttttgactatgatgagatcagaaagcagttaaagcagctgaccgatgcactcggactgccggaactgacagaagatgagctggcccgcgagcaggagtcctgtgaggaggctctggcaaaagcaaaaaatctgatcggggatatgccggtcactctggattatctgtatcatccaagaccacttggactggcaaaactgcttctgacacatggcttttgtgtgaaagctgtttatctggacagtatcagtccggaagaaaaagcagattttttctggctgcaggagcatgcaccggaacttgagctgatcgcaacgattcaggtgaagatgcgtgtactgccaagaggtgcaagcggggaagtgctggcaatcggacagaaagcggcctattttggccgaagccgtcactttgtcaatctggtacagggagaaggtctgtatggatttgacggtattcgaagaaccgcagagctgatgatggatgcatatctcaatgaaaaggatacagaaaaacttgttgtacaaaaaggatgggggtgtgagtgctgtctatgagacaatcttatcgaatgataccggtttatacggccgatgtgtcaggggtctgttctgcactgtatgaacttggcggaatgacagttatgcatgatccttccggatgcaactctacttacaatacgcatgatgaaatccgctggtacgatcaggacagtcttatttttatctcgggacttacagaaattgacgcgatcatgggaaatgacagaaaatttattgatgatatcgagtatgcagcccgtgaactgcatcccaaatttatcgcgctggcaggttcgcctattccatttatgaatggtacggattttcctgcaattgcgcgtgtgattgagacagaaatcggaattccggcattttccgtgccgacgaacgggatgaatgattatgtgtatggagcgggcattgcactcgaagaaatcgcaaagcggtttgtcagagaaccggacaggcaggagaatagagatccctcttcgcgcacggtaaatctgttaggtgtgacaccacttgatttcggaccacagaaaaatgcagaaaccttaaaagagaatcttcagaaatacggatggcaggttatgtctgtgtgggcgatgggcgatgatttgaaaacgttgcaaagatcagcggaggcagacgttaatctggttgtttcggcagtaggactccgtgtggcaaagatactctgggagaagtacaaaataccatatgtgatcggaacaccaaacgagtggctggcagaagatatttcaaatgcactggaacgtgcagccacacggcaggcagagccggcggttgtatatttgcagaaccgcatgcagcaggaggcagatatcacgctggtcggagaacctgtcactatgggatcattagcagcagggattgaaaaaagatatggtcgtgccgcccgcgtcctgtgtccgttaaaggaatgtgcggatttgctcggtgaaaaagataaaatggtgcttggagaggaagcgatggaagaggcacttaaaagtgcagggatcattgtggcagatcctctgtatcgtccgatctgtccgggggacagtattttttatgaattaccgcatgtggcattttcagggagaatatatttttgagaatactattgtcaggatgcaatttgcaatctgcgatgatgaaaaatctataggcttgatagaagaaaaaataaagaaattattaccggatgcagtgatagaaacatatttatcgggtgatgaactgattgcaagtggttgtaagccggatatgctctttttggatatccagatgccgggaaagagtgggatggaaacggcaaggattctgcgtcagaaggatgacgaagtggacgttgctgcataaaccagttgacagattcctttcggaagtataatataaagacaaatttcataggatataaaaaacaaagggcgatgttgttcagacactgcccctttttttattcgaaaacaggagggatgaggttatggaaaagttaaatgatgtgattacagcaattgacgattttgtctggggaccggtcatgctgattctgcttgtggggaccggaattttccttacgatccgcacgcggtttctgacatggagaaatctcggttatgcactcaaaagtacgttaagcaaagaggcgcggacgaaaagccgtggcgagggcgatgtgtctccgttttcggcactgaccacagcacttgccgccacaatcggaacgggcaacattgtgggggttgcgacggcgatggtttccggtggcccgggagctttggtctggatgtggatctctgctgcatttggtctgacgtcgaagttcagtgaatgtatgctggcgatcaaataccgtgagatcaatgccaaaggggagatgagcggcggcccgatgtacacgatgaaaaaggcactgaagaataaaagatttggagcggttcttgcgtggttatttgcactctttgctgtgattgcttcgtttggaatcggcaatatgacacagggaaattcgatttccggtgcattacatacgacatttcatgtgccgacccatctgaccggaattgtgattacggtgcttgccctgctgatcattgtcggcggtatcaaatccatttcaaaggtttcttcggtggtcgttccgctgatggcgattttttatgtgatctgtggcgttattgtcattatcggaaatatttcgaatctgccggcaggcattttgatgatttttcagatggcattttcggtaaaagcggtaggcggcggtctgtgcggaacgattgtcgcttccatgatgaatgcaatgcgttatggtgtggcaagaggtgtattttccaacgaagccggtatgggatctgcggcaattacggcagcggctgcaacgacggataacccggtgcgtcagggatatatcaatatgacgggaaccttctgggatacgattgttgtctgtacgattacaggacttgcgattgcctcttccggtgtccttggcatgaccgatgctgccgggaatatgctgaccggttcggatgttacaattgcggcatttgagacggttctgggatcggccgggggctggcttgtgacaatcgggattacattgtttgcgttttctacaatactcggctgggagtatcacggggaaaaagcatttgaatatctgctgggaacgcaccggtttaatatggtataccgccttgttttttcctttgttgtgtatttcggatgtacacagacactgaatctggtatggagtttttcggatattgccaatgcgctgatggcaatcccgaatctgatctgtatgctcctgctcagtggtgaaattgcaaaggatattcgggagtttcagaaagaaattcataaatataattaaaaaatgtaaggttattctttgctatcagcccgaagcgtagtataatgtagttatctgaattttatagacatggaggttaggaaattatgcagatggaacagctacgcaaagatatgatggcagcgatgaaagcgcgcgacaaggaacggaaggatgcaatttcgtctctggtctcggcagtgaagaaaaatgccattgatgccggatgcagagatgacattccggaggatatggtcaatgccacaatcatgaaggaattaaagaccgttcaggaacagatcgattcctgcccggcagaccgtaccgatttgctggaggagtacagaaaacgttatgacattatgaaagaatatgcaccgaagatgctttcgaaagaggaagtgactgcgattgttaaggaaaagtttgcagatgtgattgcaacgaagaacaagggacagatcatgaagacgattatgccggagctgaaaggaaaggcagacggaaaggtgatcaatgaagttgttacagagatgtgcaatgcataaaggagaagaaacatgagattgtatatgccaacgaaggtattttttggcagcggttgtgtttcggaaaacggtgcagagttaaaagcattaggaagcagagccatgattgtgacgggaaaacattccagccgcatcaatggttcgcttgcagcagttgaacaggcattgcaggcaaatgggcagacctatgtgatttttgatgagatcgaagagaatccttctgtggagaccgtggctgtggcagcgggcattgcagtaaaagaacaggtggatttctttgtggctgtgggaggcggttctccgatggatgcgtccaaggcgatttcgcttctggcagcgaatccatcggcaatcgatcatgcagaggaacgtctttatcatccggagccgatgcagggctatccggttgcagcagtcccgaccacatccggtacgggatcggaagtgacgccttatgcgattctgacacggcacgacttacataccaagcagtcaatcgcacacaaatggtttgcggatctggcatttgtggatgccggatatttaaagacttcttcttatgagaatatggtcagcacctgtgtggatgcgctggcacatctgattgagtcatatctgaatacaaatgcaaatgcatataaccggatatattcagcggaaggtcttcggatctggggcagtgcaaaggaatacctgctttcttccgagattaagattccggatgaaggatacgaaacattcatgcatgcatcggttgtggcaggtatggcgattgcacataccggtaccagtattccacacggattaagttatccggtcacatatgagcttggcattccgcatggaaaggcagtcggatttttcctgccgggatttttgcgtttttacaataatcagaagcgggtggcagaggtgcttgagctgcttgggtttgagaaccgggctgaatttatcgcctatctggacaagctgctgggcaaaccacagatcccggaggaactgtgggaggaggatgtgcagaaactgttgcagaatcctgccaagttaaagaactatccgtttgagatgacggaagaaattctgaaaaaatatctaaacaaatgagaaccagtttgaggaggaaacttatatgatacaaaagttgattgaaaagttaaataagaagagattaaaagaacgaatttcttctgcaattgtgatggtggccctgattgttagcatttccggtgttgtgggagccgtatccggaattgtggtcagcaaccgctataattatgcattgaaaaattatggtttttcacagggtgatatcggcaagatgatgattacgtttgccgatacgagaagttatctgcgtgctgcgatcggatatcaggatgaaaaccttgtgaacagctgcgcagaaaattatgagaagaagaaggaatcctgtcagcagtataccaaagaggtaaaaaatacggtttcatctgcggatgaggagaaaatttataatagtatcacagaaaaactgaacgattattttgacacctgtgatgctgtactggaaaaaggaaagaatacacaggatattgatgcgcgccatgaagcacagcagatggcacaggatcaggtggcaccgatctatgaggagatttatcaggatatggtgaaactgatggatgcaaataccgagcatggagataagttagagaaaattcttacaatggtagaattgatcacacttattgcaattattgcggttattgcacttgcaatttttgtagcccgccggatcggcagagtgcttgcacagaatattgttgatcctttggatcagctgggtgctcgttttgatacatttgcaaagggggatctctccagcgaattcccggagatgacatcagaggatgagatttccgagatggtagttgttgcacgcaagatggcaaagaacctggcagctgttattcaggatgtcagccaccgtatggatctgatggctcacaacgattataccggtgtttccaaaatcccggagaaatatatgggtgagtttgcggcaatgaatgatgcaatccatgtcatgaacaccgatatgaatgagacgatgcaccggattgaggaggctgcttcccaggtatctgcaggttctaccaacctggcagagggatcacagacactggcagagggatctaccgatcaggcaggtgcagtggaagaacttctggcatcctttgccaatatcacagaaggggttgagcacacacatgagagtgcacaggcttcttacgagttatctgtaaaatatgcacaggaagcagataagacacagaaggaaatgaatgcagttaccgaagcaatgaagagaatcagcgatatgtccaagcagattgagacaatcatcggacagatcgaggagattgcggagcagacgaacctgcttgcactgaacgcatccattgaggctgcacgtgcaggagaagccggcaagggctttgccgtagttgcatcccagatcggaaaacttgcggatgagagtgcacagtctgcagtcaatacccgtgagctgattatgaactctattcaggaaatcgaaaacggcaatcaggcagttgatgtgactttccagacgattatttctcttgtagagggaatcaatgaagtggcaaagaaatcccgggaactggcacagctttccgagacacaggcagagcagatcaagcaggcagagtccggtgtaaaccagatttccgaggttgtacagagcaacgcggcaatcgcagaggaatcttccgcaaccagtcaggagctttctgcagagtctgcttctctgaatgatctggtgcagcagttcaagttaaaatagtgatacaaaataaaggtataagagaggaacaatctggaaaatggatacgtcgatttttatcggaacatggtggtcactggtgccgcctcttctggcaatcatactggcacttgtcaccaaggaagtatacagttccctgtttattggagtggcggtcggagcactgttatataccggatttcatccgtggaatgcattcaatgccctgttttcgattatgaaagacagcatgaatctgaatattctgatttttgatgtgctgcttggaatgattattgtattgatgtcaaaatcaggaggctcagctgcttatggaagatgggccggcagcaagatcaggtcaaaaaagagcgcaatgctggcaaccacaggacttggaatgctgatttttgtggatgattatttcaattgtctgaccgtcggatctgtgatgcgtccggtaactgaccgctacaaagtatcccgcgcaaaactggcatatatcattgatgcgaccgctgcgccggtctgcatcattgcgccgatttccagctgggcggcagccgtcaattcgtatgttccgaaagatgccgggattacgggatttcagctgtttctgcgaacaattccgtacaatctctatgcgattctgacgattgtcatggtattttttgtgattattgcaggttttgatttcggactcatgaaaaaacatgaggagaatgctgcaaaaggagatctgtttaccagcggcggggaagagtttgaaaaggttaaggaagaagatatttcttccaacggaaaagtgattgatctgcttcttccggtgattgttctgatcggttctgcaattggtgccatgatctataccggatttctgggcggtgcgaccgatgtggtcagtgcatttgcaggatgtgatgcggagaccagcctgatttttgcaaccatggtcacggtctttgtcatgctgtttttgtatcttccgcgaaaggtggttacgtttaaaggattcatggagagttttgtggaaggctttaagctgatgatcccggcgatcggaatactgatatttgcctggaccttaaagggaatgggagatgctctgcagattggtacatttgtggaatccatcgttggaacgagtgcttctgcaagcctgttccttccggctgttttgtttgttgttgcagtgttccttgcgttttctaccggaacaagctggggaacatttgcgattcttgttccgattgcaatcgccatgtttccgggggcagatcatctggaaatgatgatcattgcggtttccgcagtgctggcaggtgccgtctgcggggatcatatttcaccgatttcggatacaacggttatgtcttcggccggcgcgcagagtaaccatatcaaccatgtgacaacgcagatgcagtatgcagcggttgttgctgtggtatgtatcattggctatatcattgcaggactggtacagatctggtgggtagcacttggcatcagcctcatgctcctgcttgctgttcttacctttataaaaaagaggtcggggagcaaccgcgaaaagacagcaggtatataagaatcaggacagaagcccaaaaacaaagaaaggagcaggcgaggaaacctgctccttcttagttacttaaaggaaattgagtaactgagtagttaattagataattgtttaataaaattgaactacatactcatttgcgtacgtgcatgctatatttaaataacaccattcaatacttacattataccgtgttattcggattttgcaatacctattttgaaatttttggaattaatcctttattttcgctattccggaagcggaaggaagtccggctttctgccggtaaagaccgtaaagtaccggaagcctgcatgccgcagaatctgaggaagacggtcaaacgcatatgcaacgtgctccggcgcatgggcatcggctccgagtgtcagaatctctcccccgagttcgtgatagcgtaaaagaacagcttcggtcgggtttggatgtcccagcccgtatttgaatcctgccgtgttgacttcgatcccttttcccatggaaatgagtttacgcagaatctcatcaatgatatcggcataggcctcatatgtatagaaacggttgcggtccggaccgtagcggacaacataatcgagatgaccgtatacatcgaagtcggaataggtgttcaggttttccagaatggattcgaagtactcgcggtaagcagttttttcggagcgtcctttatagtatttcgggtaatagggatcgattccgtgaacaacgtgggaggaaccgatgacaaaatcaaacggatgtccggtcactgctttgcggttgatttccgtgatgtggggctgcagaccgacttcgattccaagacgaatggaaagacggtcacggcaggtgtcctgaaaactgcggacttcttttatataggaatcaaaatccagaagaaacagattgggatcatccgggtaatcataatcaaaatgatcggtaaaacagatgccatccaggttctgccgtacagcggcctggatcatgtcaggcatcaatgcgtcactgtctccgctgtgatgcgtgtgcatatgtgtatcccaaagcataagagcctccttttttctgtgtggttgattttggaaaaagtcttttcgtaagattatactatatttcaggggaaatagatacctttagtgaaaaaattaacaaagacggagaaaagacttgaactttcggaaataattgggtaaaataaaggaagcttgggacgcaagtcccatgagactatttatttacaattctaggaggaattaagaatggcagtaagagtagcaatcaacggattcggccgtatcggtcgtcttgctttcagacagatgttcggagcagaaggatacgaagtagtagcaatcaacgacttaacaagcccaaagatgttagcacacttattaaagtatgatagctcacagggtaagtacgagcatgcagatgaagtttctgcaagcgatgattctatcacagtatgtggtaaggaaatcaagatctacgctttcccagatgcaaacaattgcccatggggtgagttaaaggttgacgttgtattagagtgctctggattctatacaagcaaggagaaggctcaggctcatatcaatgccggagctcgtaaggtagttatctctgcaccagcaggaaacgaccttcctacaatcgtttacaatacaaaccacgagacattaaaggcttctgacacaatcatttctgcagcttcttgtacaacaaactgcttagctccaatggcagatgctcttaacaagtttgctccaatccagtctggtatcatggtaacaatccatgcttacactggtgatcagatgactcttgatggaccacagcgtaagggtgatttaagaagatcccgtgcagctgcagttaatatcgttccaaacagcacaggtgctgcaaaggctatcggtcttgtaatcccagagctgaacggaaagttaatcggatctgcacagcgtgtaccaacccctacaggatctactacaattcttacagcagttgttaagaaggctggcgttactaaggaagacatcaacgcagctatgaaggcagcagctaatgagtccttcggatacaatgaggacgagatcgtatcttctgatatcgttggtatgagattcggttctttattcgatgctactcagacaatggttaacccaatcggtgatgatctgtatgaggttcaggttgtttcttggtatgataacgagaacagctacacatctcagatggttcgtacaatcaagtacttctctgagttagcataatctatcttagtttatgtgaaagggtccggcctgtagggccggaccttttttcattatgacaaaataagaagaaaaggaaagggttccgctgttttatgcagctgcggagtatgaaacaaccggctggaaagtcatttccttttcttcgggtttaaaattgccgaaaaggcagaacggagaataaaaacatggcattaaataagaaaacagttgatgatatcaacgcaaagggcaagagagtccttgtaagatgtgacttcaatgtaccactgaaagctggcgagatcacagatgatacccgtatcaaagctgctcttcctacaattaagaagttattaaacgatggtggaaaggtaatcctttgctcccatcttggaaaagtaaagaacggaccaaacgaaggagagtcccttgcaccggttgccaagagacttgaggagcttctcggacagaaagtaaacttcgtatctgattacaacgtaacaggcgaggcagctacaaaggctgttgaggaaatgaaagagggagaagttgtattacttcagaatacccgttttcgtggcgctgaggagacaaagaacggtgagcagttctctaaggaacttgctgatcttgcagacatctatgtatgtgatgcattcggttcctcccacagagcacacgcttctgtagctggtgttacaaagttcatcactgcaaagggtggacagaatgttgttggttacctgatggagaaggagatcgccttcttaggaaatgctgttgagaatccggtacgtccattcgtagcaatcctcggtggtgctaaggtagcagacaaactcaacgttatcaacaacctccttgagaagtgtgatacccttatcatcggtggtggtatggcttacacattcatcaaggctcagggatatgagatcggactttctctctgcgatgatgagaagcttgattactgtaaagaaatgatggctaaggctgagaagatgggcaagaagatccttcttcctgtagatgctgttaccatcaaggatttcccggatccaatcgacggacctgtagagacagaagtatgtgatatcacagctatgccggcagaccgtgagggatgcgatatcggacctaagtccgcagagatgtttgcagatgctgttaagacagctaagactgtagtatggaacggaccgatgggtgtattcgagaacccgacacttgcagctggtactcttgcagtagctaaggctcttgcagagaccgatgcaacaacaatcatcggtggtggagattccgctgctgctgtaaaccagatgggttatgctgataagatgagccatatttctaccggtggtggagcttcccttgaattcttagagggtaaggaactgccaggcgtagtagcagcagacgataaataaaagacagttaaattatttacagattaggagaaataaaaatcatggcaagaaagaaaatcgtagccggcaactggaaaatgaacatgactccaagccaggctgtaaagttagtagaagagttaaagccattagtagtatctgatagcgtagatgttgtttactgtgtacctgcaatcgatatcgtaccggttgtagaggctgtgaaaggaaccaacgtacaggttggtgccgagaacatgtacttcgaagagaagggtgcatacacaggtgagatctccgcagagatgctggtagacgctggtgttaagtacgttgtaatcggacattccgagagacgtgactacttcaaagaggatgatgttctcttaaataagaaggttaagaaggcaatcgaggcaggacttactccaatcctttgctgtggagagactttagagcagagagagatgggtgtaacacttgactggatcagacttcagatcaaatctgatcttgcaggcgttgcagcagcagacgttgcaaacatggtaatcgcttatgagccaatctgggcaatcggaacaggcaagactgctacatccgatcaggcacaggaagtctgtggcgcaatccgtgcatgtgtagctgaaatctatgatcaggctactgctgattctgttcgtatccagtacggcggatctgtaaatgcaggaaatgcagcagagctgttcgcaaagccggacatcgatggtggtctggttggcggagcatccctgaaagctgatttcggtaagattgtaaactactagaatctgattttgtatggttatagggctattcatctgaatttcaggtgaatagcctttgaaattttacacatgaagaaaaaatgtctggaatgtgtcgttctcttgttgtttatttttgctttgacacatggcatcatccaaaatacacagccgctgaaagagactaaggaagtacaaactgaatatgaggaaaaaacctcccaggtcacggaacaatcacaggaaaccgagtcggaagtacaggatctggaaaaccagattttaaggactgcctccggaaagttttttcagaaatatccggtggatgaagcctttatgggatggattgaaacgaagtatgggagcggtgtgctgcagagtctgtatacacagctggaaaacggaaatcaggacccggatctgtggtatcggtttaccggaaacagtatgcatgttctgtggcttatgtattgcaggcagcaacagtatatgtcgtattcgtatgaggatgtgatctggaaagaagcatccgatccggcatgcatccgtctggattttgtcggggatatctgtctggatgagaattggtgtacggggaagacggcaaagaatcacatggcggattatttttccgatgaagtaaaaaaggaactgatttcggcagattttacgatggcaaacaatgagtttgcttatacaacacggggacagcggcaggttggcaaagcatactgttttcgggcagatcccaaagatgccggattcctgcgcacactgggaatagatatggtctctgtggcaaataatcatgtgtttgattatggtgagcagggatttttagatacgctggatgcattgcatgcagcgggaattccgtacagtggtggtggcagaaatctgacagaggcaagcgctgtgcgttatgtggtcacaggtggacgaaagattgcgattgtatctgcaacggaaatcgaaaggttttatcattttacacagaaagcccagaaggagaaaccgggagtattaaagacccagcaggaagaggtatggaagaaagaactgaagtgtgcgaagaagaacagtgattatgtgatcgcgtatgttcactggggaacagaaggaaagatccattatgggcaggatcagacagagattgcagacctttgtgtaaaagctggtgcagacgccgtgattggtggacatccgcaccgtctgcagggcgttgagtttataaaaaatgtgccggtggcatacagcgtgggaaatttctggttttctaccggaaaactttacacaacgattgcacagattcagattgatgattccggcagtctgaaattgcggatgattccgtgcatacaggattcgcttacgccttcgattctgacagaaaaaaaacagatcaaagcattttatcattatctggcagacatctccaatcatgtgggaattgatgaggacggattcttttatccgtataaaaatgtcgaaaaaccgggagtttctccttatgcctatacgtccggaaggcgttatggacagtattttgatgatgtggatctggatttaaaatcgatagatatcgtgggaaatttgcagtgaacacttgcaatcccgttcaaattatgtaatataataagtgtttgtgtaacaataatgaagtaccatagtataggattgttacaatggaaagagaggatgaattatgagcaaaaaacctgttgttttaatggttcttgacggttatggtctgaatgaccgtacagagggaaatgccattgcgctggcaaataccccggtgatggataaattaatgaaggaatgtccttttgtaaaaggacaggcttccggtctggcagtaggacttccggacggacagatgggtaactctgaggttggacatatgaatatcggtgccggccgcattatttaccaggatctgaccagaattaccaaggcaatcgaagacggtgactttttcgagaataaggcactgcttgcagccatggataattgtaagaaaaatgattcggacctgcatctgtggggacttctttccgatggtggtgtgcacagtcatattacacatctttacggactgcttgagatggcaaagaagcagggactgagcaaggtatatgttcatgcattcttagacggacgtgatacacctcctgcatccggaaaagaatttatcgaagaactggaaaagaagatgaaagagatcggtgttggaaagattgcttctttatccggacgttactatgcaatggatcgtgataataactgggatcgtgtacagaaagcctatgattccctgacaaagggggagggcgtacaggcagaagatgccgtaaaggcaatggaagattcctatgcaaaggatgtaacagacgagttcgtacttcctaccgtaattacagagaatggaaaaccggtctctgttgtaaaagagaatgattccgtgatcttctttaacttccgtccggaccgtgcccgtgaaatgacacgtgcattctgtgatgacaagtttaccggatttgaccgtccgttcattaagacaacatttgtctgctttaaggactatgatgagacgatcccgaacaagctgatcgcatttgaaaaagagcatattgtaaatacattcggtgagtacctggcaaagtgcggaaagacacagcttcgtctggccgagacagagaagtatgcacatgttacattcttctttaatggcggagtggaagagccaaacgttgatgaggcacgtctgctggtaaattccccgaaggatgttgcaacatatgatctgaagccggaaatgagtgctccggaggttggtatggatcttgttgaggctattaagtcagacaagtatgatgtgatcgttatcaactttgcaaacccggatatggtcggacacaccggtgtgattccggcagccatcaaggcagtcgagcgtgtggacggactggtaggagatgcagtccaggcggtgaaggatatggatggtgttctgtttatctgtgcagatcatggaaatgcagagaaaatgattgactacgaaacaggtgagccacatactgcccatacaaccaatccggtaccgtttattctcgtaaatgcggatccgaagtatacactgcgtgagggcggatgcctggcagatattgccccgaccctgcttcagattatgggattagagcagccgaaagagatgaccggaaagagtttgttaatcgaaaaataaaagaataaggagagcggaaatgaaggaatttaaaccattcaaagaaggaaaagtaagagaagtctatgataacggagacagcctgatcattgtagctactgaccgtatttctgcatttgacaacattttaaagaacaggattacggacaagggcgcaattctgacccagatgtcaaagttctggtttgattttacaaaggatgttgttccgaatcatatgatttctgtagacgtaaaggatatgccggaatttttccaacaggagcgttttgacggaaacagcatgatgtgcaagaagcttgagatgctcccaatcgagtgtatcgttcgtggctatatcacaggaagcggctgggcaagctacaaagaaaacggcacggtatgcggcattaagcttccagaaggactggtagagtctgataagcttccggagccgatttatacaccgagtaccaaggcagatctgggcgatcatgatgagaatatttccttcgagcagtcggtagaggtactggagaaaatttatcctggaaaaggacttgattacgcaacacagatcaaggattgcaccatcgctctctacaagaaatgtgcagagtatgcactttccaaaggaattatcattgcagataccaagtttgagttcggtctggacgagaacggtaaagtcgttctcggtgatgagatgcttacaccggacagctccagattctggccactggaagggtacaagccgggacagggacagccttctttcgacaagcagtatgtcagagactggctcaaggcaaatccggacaatgatttccttcttccggaagaagttgttacaaagaccgttgataagtacaaagaagcatatgagcttctgacaggtaagccttttacaagatagatataggagatcacaatgattcagaataacagttatgatgcggatacacttcatgaggagtgtggcgtcttcggaatgtatgattttgacggtgcagatgtagcatcgacaatatattatggactgtttgccctgcagcaccgtggccaggagagctgcggtattgcagtcagcgataccagcggtcctaagggcaaggttctttcctacaagggaatgggacttgtaaatgaagtgttcgcaccggaaaatcttgagcagatgaagggggacatcggagtcggacatgtacgttactcaacggccggttcttctacccgtgaaaatgcccagccactcgtgttaaattatgtcaaaggtacattggcacttgcccacaatggcaatctgatcaatgcaccgcagcttcgtaaggagctggaatatacgggagcaattttccagaccaccattgattctgaggtgattgcctactatattgcgagggaacggttgaattcccagtcagcagaagaagctgtgcgccgtgcgtgccagcgtcttaagggagcttacgcactggttgtgacaagtccgcgtaaattgatcggggcgcgtgacccatacggctttaagccgctttgtatcggaaagcgtgacaattcttatattatcacatcggaaacctgtgcacttgacaccattggtgcaacatttgtgcgtgatgtgctgccgggagaagttgtgaccatttctccggaaaaaggtattgagtccgatatgaccatggcacttccgaaagaaaaggaagcacgctgtatttttgagtacatctattttgcaagaccggacagtcatattgacggggtgagtgtatatgcaagccggatcaaggccggaaagtttctggcacaggattcgccggtagaggcagatctggtgacaggtgtgccggagtccggaaatgctgcagcacttggctattctctggcatccgggattccgtatggtacagcctttgtcaagaacggctatgtgggacgtacgtttatcaagccaaagcagagcagcagggaatccagcgtacaggtgaagctgaatgtgctgcgtgaggcagtggcagggaaacgtgtcattatgatcgatgattcgattgtaagaggtacgacatcggatcgtattgtgcgcatgttaagggatgcaggagcaaccgaggtgcatgtacgcatcagttctccgccatttttatggccttgttatttcggaaccgatattccggcgcgtgagcagttgattgcctacaaccgtacgattgaagagatccgccagattatcggagcagattcccttggttatctcggaatcgaccgtctgaaagaaatggcggaaggacttccgatctgtaccggctgttttacgggcaaatatccgatggaaccgccgaaacaggacattcgcggtgagtattatgacaaagagattgatcttgagcgcaagatgagccgataagttgttaccaatgtaatcaaataaaaggagaagaacatgagcacagacagatatacaagccctctttccgagcgttatgccagcaaggaaatgcagtacattttttcccaggatatgaagttttccacatggagaaaactctggatcgcactggctgagacagagatggaactcggactttccgagaatggaaagccggtcatcacacaggatatgattgatgagatgaaagaacatgtcaatgatattaattatgatgtagcagtcgcacgtgaaaaactggtgcgtcatgatgtcatgagtcatgtgtatgcttatggacagcagtgcccgaaggcagccggtatcattcatctgggggctacttcctgctatgtcggagataatacagacatcatcattatgaatgaggcattaaagctcgtacataaaaaactggtcagcgtgattgcggagctgtccaattttgcagaaaaatataaggatcagccgacccttgcatttacgcatttccagccggcacagccgacaacagtcggaaagcgtgcaacactctggacacaggagtttctgatggatctggaggatctggagtatgtacagagtacgttaaaactgctcggatcgaaaggaacgaccggtacacaggcaagtttcctggaactttttgacggggatcaggagacgatcgataagattgatccgatgatcgcagagaaaatgggatttaagtcctgctatccggtttccggacagacctattcccgtaaagtggatacccgtgttttaaatgttttagcagggattgctgccagtgcgcataagatgtctaacgatatccgtcttctgcagcatttaaaagaagtagaggagccatttgaaaagaaccagatcggatcttctgcgatggcatacaagcgcaacccgatgcggagtgagcgtatcgcttccctgtcccgctatgtgatggtagatgcattaaatccggccattacttctgcaacacagtggtttgaacgtacacttgatgattctgccaacaagcgtctgtcggttccggaaggattccttgcaatcgatggtatcctggatctgtgcttaaatgttgtagatggcctggtggtatatccgaaggtaatttacaagcactttatggcagagattccattcatggcaaccgaaaatattatgatggatgccgtaaaagagggtggaaaccgtcaggaactgcacgagaaaatccgtcagctgtccatgcaggcaggaaagaccgtcaaggaagagggtaaggataacaatctggtagatctgattgcagcagatccggcttttggtctgacaaaagaacagatcgaggcaaacttaaaaccagagctgtatgtgggtcgtgcaccgcgtcaggtggaagtattcctgcgtgatgtggttcgtccagtgctggatgcacacaaagaggaactcggcgttactgcagaaattaacgtataaatgaacctataaacagaccggtcggttatgctaagaggggctgtaaaataagtccctaatataagaaacgccaattccggcaaatgtcggttttggcgtttctttgtattaacttttctatttctaagcaagtctgcatctttgggtataaaaaatggtgcatttaataaagctcggctaatcacgcccgcttaagttttatgcaactttcgtctgtcgttgctttttgttgtgatatttataaagattgaatccacatgaaatcagtgtaagctcgagaattacatttttctcgcctcttcgcaataatcttttatacgctttatcccactttaatacaccaaaagttccctccgattgaatacttcggttcattctcaagagagcaccatgtatggattcaagattttgcagcacttcctgatggatagcagttaattcctgattcattcggatcgttcggtttttgtgtgctctcggacaacattcttgtttatgctgacacccttcacaagattcacattcgtataattcttccgttcttccatatttattatatttcacatgttgtgttctcttgaagaggaattttcgaccgtttggacataagagatttccatctgcatcttttgcaaagtttacagcacgatacggattctcatgatactttttgtccgtcgtttcttttttgtacatggtaaatttcatgtatttttccatgccgtgttcttcacaataaagataattattgtaagaaccgtatccggcatcagcaaccggatatttcggatagtggccatatgtgcgattgaatttttccatcaaaggaacaaagcattccatatcggatgcatatggttttacgtcgattacagctatgtattcatcacagatggctgcctgtaggttgtatgccggaagtagctgatcgtttcccatgtaatcacgctttaaacgcatgaaagttgcatcatgatctgttttggaataactgtttctttcttctccacaggtctcgatatgatatgcataggatttcaaacgttccagatattcatgcaattcttcgtattgtttttgtcgaatgctttttctatgaccacgtccggaaacgaaagaagtttcatccagtccggttgtttctttgtacatcgtaagtaattcagagacatagtcaaccgcgtacgcttcacgcttttcaaattttattccgagatatccaagtacttcccgattcatagcatcaatcaagagtgaaatcttgtcaaagactttctgccggtttttcacacacgattttttccatacccaggtatatcgattggcatttgcctcaatttttgtcccgtcaatgtatgtatgctgcagatccacgtgatctttggcaaaaatatatgaattaatgtcttcaaatatctgctcgatagaatcggttagttcgtttcggattaagtttccaaatgtagcaaaagaaggcgttttcatgccatcaagaagatacatgtaacgaatgtcattacggcagagcttttctatttcccgtaaggagcagatgccattttccataaaggcaaaaagtattactttaaggagtttttgagcatcacatcttgggcgacctgttttatagcctttctctacaaaatatctggataggtcaatgtgatccataacctcacaaaaagtgtataccggatcggaaatatcgatcaatttttcgatttctaatggtaatttcagctgacgcatagtataattaccattggtattgttatttagtagcataattaattataccaaaaaatcgctcagacctcacggtctgggcgatttttctgtcaggggagtttttttacagcccctttctttttctttggatttgaataaatttctttctttttcacacaataatgaaaaaaggaggacaataggaatgggtctgatgatcaaaattattgaaattcatggaagggaaattctggattcaagaggaaatcctacggttgaggtggaagtgaccgcgcagacagagacaacgggaaagaagactacgggcagggaatctgtgccatccggagccagtaccggaagatttgaggcgattgagctgcgggatggacaggaacgttattttgggcttggagtacagcgcgttgtggatcacatcaacacaaagatccgcaaggaactgctgggaatgaatgtgctggaacaggtacagattgaccgcaaacttgtggaactggatgggacagacaacaaaggaaatctgggggccaatgctttacttggtgtttctttagcctgtgcgcgctgcgcagcggcagcattggatatgccgttgtaccgttatctgggaggaccgaatgcaaaaaaatggccgatgccgatgatgaatgtcataaatggcggagctcacgcaaagaattacctggattttcaggaatttatgattgtaccggtcggagccgagtcgtttccagatgcactccggatgggtgcggaaatttatcattttctgaaaaaaattttgcagaaagaaggcaaactgacggcagtgggggatgaaggcggatttgcaccggatttttccaatgcgggagaagtgtttgcatgtctgcagcgtgccgtggaggaagccggatataaggtgggcagcgatgttgcatttgccatggatgcggcagcatccgagctgtacagagaggaagacggaatgtatcattttccgggagaagcgcagacacatgcagaggtggatgtcaatctgcggcgtccggacacgcagggaggtgcctatacatctgacgcacatgtgaaaacgcaggagatcaccgaaaaaaaagaagtcctgcgcagtgcacaggaaatgatttcactgtatgaagaacttaccacggaatatccgctgatttctattgaggacggtctggatgaagacgactgggaaggctggcaggaattgacaaagcgcatgaaagaacaggtgatgctggtaggggatgatctgtttgtcacgaatgtgaaacgaatccggtgcggaatggatcttaaggtggcaaatgctgtgctgattaaggtcaatcagatcggaacgcttacggaagccatggatgcgattgaactggcacagaagaacggctataaggcaattatttcacatcgttccggagaaacggaagattcttttattgcagatctcgcggtggcagtaaatgccggctggatcaagacaggcgctccgtgcagaggagagcgcactgccaagtataaccagcttctgcggatcagtgaaacattataagagattcagacgtttggacatgatctccggattgaccgcttccgagatggcggtgtgtttgtcgattcgtccgtctttataaagctgtaagatgctactgtccatggcgatcatattttctgcggcagaagtgtagataataccgttgatctggtggacttttccttcgcggatcagattgcggatggcaggggtgagcaccatgatctcaaatgcagggatcatttccccgtttaccgaaggaagaagcttctggcagaatacggccaatggtattggccgcaccgatggtgtggagtgaggaaaagatcatatgaccggtttctgcggccgtgacagcggtatttatggtttcataatcacgcatttctccaaggagaatgacatccggactctggcgcaatgcagcacgaagtgccgtcagatagcttgcggtatcggtattgatctcccgctgggaaacaatgctttccatttcgccggtccgggaaccgattgcaatccagctggcgtacatctgggaaaagatgccggacagcagcagtgctttgtcgaatgattccccgtggcggatattctcgtgacatttgtcgataagtgcctgcatatgcggattattgacaagttcgcgtgccagggtaagaccgatattactgtcgagtccgctggagagaaccagatacaggcagtttgcaacgcgtccggaggcaaccgtcatggcaagtttctgtccgaggaacaatacgcgcccgagatcggtgtgatataaaatcatacagatgataagcaataccagaaaggcaatgataaatccaagcatataatgattgagaatggtactgatgtgcagaagcgtccgtgcggtcccggtcagctcgcttccgagttcggcataaactttggaaaaaacaggtacgacttttgcatcagaaccagaatcacggcgatcatcagaaaggtcatgactgcagcgtaatcaaaacagattcctttctcagaggtgaaaacctcatcgatatcgggaagatatccgcttgttacactggaagctttggaataatcataggtaaaatgtgtaatgatataattatatacactgctgatgatgtacagatcgctggaagcaccgtctgcaagttcttcggccttggccacagggagggaatcggcggtgaagttcacgtactttgggaacatccaccagtgaacagacagacacacagtaatataatcggaataaatctgtacatttgacaggatttcatggtatactcctaatgatacagtaagttctatattatctgtgttatattataaagtggaaatgaaaaggaaaattgtgaaatataaaaaaatgttgaaaagacttttcttttatgatataattagttagtcgtgagtttagaattaggaggtggaaatcgtgaccgttttaaatacgattttaactattgtatttattatactgagtattgtaattacagtgattatcttaatgcaggaggggaaatctgcaggtcttggcgcgatcgccggagcagcagatacttactggggcaaaaataagggacgttccatggaaggaatgcttgtaaagcttacaagaatttttgtgattctgttccttgtcattgcaatggttctgaatttgggaatctggtagaaaccggaagctgtcgattacatcggcagcttttttcattatataaggagaagatctgggtatggacgcaaagtatgaacagcggaaaaaaatgatatatgactttatgtgcgatgatatgtatgtcccgatgaaaatcaaggaactggcgattgtcctcggtgtgaaaaaagatcagcgcccacagttggaacagattctgaatgatttgatgatggaggggcgcatcgtctgctccaagagaggaaagttcagcaaatccgaagagaaaaagatcacaggcacgtttcaggcacatccgaaaggatttggatttgtcagtgtggagggggaaaaggaagatatctttattccggaatccgaaactaacggtgcgatgcatatggatacggtagagatttccgtatcaccggcagtgaccggacgccgcagggagggaaaggtgctgcatgtgcttgaacggggcatgaagcaggtggtatgcacgtatcagctgaataaaaattttggatttgcagtgccggataatccaaagttcgggtcggatatttttattccgctggagcgttcgaaaggagctgtaaacggtcataaagttgttgttgagatcacgcagtacggaaaaaagggaaagaatccggaaggaaaagtggtagagattctcgggcatatcaatgatccgggggtggatatcctttctattgtgcgcgcttacggtcttccggtggaatttgatccgaaggtcatgacgcaggtagagcatgtggcaaagccggtatcggaagcggatatggcaggacgcatggatctgcgcgactggcagatggtgaccatcgatggcgaagatgccaaggatctggatgatgcggtgtcacttaccatggaccatgaaaattatattctgggtgtgcatattgcggatgtgtccaattatgtgcaggagcacagtgctcttgacacagaagcgttgaagagaggaacttctgtatatctggtggaccgggtgattccgatgttgccgcatgccctgtcaaacggaatctgttcccttaaccagggggaagagaggctggcactcagctgcatcatgacggtcaatcctaagggcgaaattatcgatcacacaatcacagagtcagttatctgcgtggaccggcgtatgacgtataccaatgtgaaaaaaattctggcagaccatgatccggaggtgatggcggaatatgagccactggttccgatgtttgaaaagatggcagaactggcggcaattcttcgcaaaaagcgtatgaaacgtggttccattgactttgattttccggaaacaaaggtgattctggataagaatggaaatccggtagatatccgtccgtatgaccgcaatgtggcaacgaaactgatcgaggattttatgcttgctgcaaacgagacggtggcagccgaatattactggagagaacttccgtttgtctatcgtacgcatgagcagccagattcggaaaaaatacagaaactatccacgtttatcaataatttcgggtactctctccacataggaagtgatgaggtgcatccgaaagaactgcagaagctgctggaaaaaatcgacggaacttcggaggagccgctgatcagccgtctgacccttcgctcgatgaagcaggcacgctatacggtggaaaataccgggcattttggtctggcagcggattgttactgccattttacttcaccgatccgccggtatccggatctgcagatccaccggattatcaaggacagtctgcggggacgtctgggcgaaaagcgcattggccactatacgcagatactgccggaggttgcaaagcatgccagtgagatggaacggcgtgcagatgaggccgagcgggagacaattaagctgaaaaaagtgcagtatatggaaaaccatatcggagaaacctttgccggtgttatttccggagtcgcagagtacggatttttcgtggagctggaaaatactgtggagggtctggtacgtgtgacttccctcaccgatgatttttatcagtattatgaagaaacttatgaactggtgggagaagcaacgaaccgcaggtttaaactggggcagcaggtgcgtgtgacggtggataactgtgaccggatcatgcggacgattgattttacacttgcagattctgacgaaaattgatggaattcttaaaattttcaaaataaaagcagcagtttattgcattttgcaggaaaatcatatacactgagtttacagaacaaaaaggagggagccgggatggcgaaacaaccgaagaagttaatagccaacaataaaaaagtctatcacgattattttctcgaagagacttttgaagccggtatcgctcttgctggaaccgaagtaaagtccatgcgcatgggcaagtgcagcatcaaggaatcctttatccatattgaaaatggggaggtgatcctctatggtatgcatatcagcccatatgagaagggaaatattttcaacaaagatccgctccggccgcgcaagcttctgatgcacaagaaagagattcagaagatggtcggtaagatcgcgcagaaaggatacacgattgttccagtggaagtatacttcaaaggaagtcttgtaaaagtgcaggttgctctggcaaaaggaaagaagctttacgataagcgtcaggacattgccaaaaaagaccagcggcgggaagccgaacgggatttcaaagtgcggaatcttggataggtgtttcgcaaaaaaggcgggaggcaagagttatatttttgctccccgaggaaagaggagcgcagtcaagctttcgctacgcaaaatcttgatgcgaggcaatattttttgcttcgcaaaaacattgcaagggctagtaatggtttcgacagggatcatgcagctggagaagcgagtcgtacgggatacgttaaattccacaattaaaattaaacgctgaagataatttagcatacgctgcctaatggcagcagtctgacctagggcactcacactttaggatccaggcttcgactctgtgagaaacgacgcaggctaagctttgcacctgtgggcgtatcatgaagctactaaaaccacaaggatgtttgttttcgtgtggcggagggaatgtcaaagaataaactacactcgtagaaggacagggaattggtttttggacacgggttcgactcccgtctagtccactaaaaaaggtgcttaaataagcacctttttattttaacaattccgtgatattgattacaagattatcataaatacatacctgtatatcatcatcaaaacggtattgatctgacttttctggtgaatccggtttggcggtgccaaatgaaattatagcataatatcgtgagtgttattttagtggaaaaattacgaaaaaagtgatagcatgatagcatagaaaataaccaaagatgaaggagaagaaatgtttcgactggtggcagatattacagaattaaatattgatcaggtaaagcttccgaagattccgggactgggtatgcttatgaagcttccaaataaacaaaaaatttccatgattgtcagtgttttgaatgcgcagaaaggtcagttccttccaaaatggcaggaggcagtgaatcagaagtgggggcagttgcagcttttggattatcaggtggaacagccgggggacggaagctgtctggcgcgcatccggattgatgtgggaaatgcggattacgataaagcgattgattcggtcattccgcatgtgtttcaggaaaaggatgcccatacggtgctcggcgaggattatgccggatctggaaacctgcaggaagtgatgcaatttatgcacaatgcaccgacggcggcaaagaaggaattttacattgtaaagacattaagcgtggaaaaggaaacaattgcaagaaactttgaaaacagtgcggcttcccagggagcggtacttcgaattggaagtctgcgttttttcctgaaacaatcctaaaaaggcaaaggaacaaaagatgttaggaaatacaaaaggtaaaatgattaatcagtatgtgccggattatgtactctatgatcttgagacaaccggtacttcgagtaaatatgacgaggttattgaaatttcggctgtcaaagtaaaaaacggcgtggttacagaagagttcagtcagcttgtgaatccgggcagaccgattcccagcgcggcaagtgcagtaaatcatatcacggatgatatggtggcgtttgcaccaatgtttgattccgtattgcagcaatttcttgcttttatcggagatgatgtgctggcaggacataatatcaatcgttttgatatgaaatttttgtatcgtgattgtgaacggtatttcggtcagacactaaccaacgattacattgacacactgaaactggcacggctctgtctgccggaactttcgcatcatcgtctggaggatctggcacagtattacgggatttccacggccggggcacaccgtgcattaaacgactgccgcatgaaccagcaggtttttgaaaagctggcaaaggagctggatggtactaccgggcggaatattgaaataaaaaattgtccggtgtgtgggcagccactgaaaaaaaggaacggaaggttcggagagttttggggatgtatgggatttccgacatgcagatatacagaaaatatatgatatatgacggaaaaaccgtaaggaggagtgtatgaaaacaagggaagaggcgctggcatatgcattgtcttttccgaaaacctatcaggaggcgccgtttcatgataataactggcagcttgtgcgggtagagggaagcaaaaaggcttttttgtggacctatgagagggaaggatacattaatttaaatgtgaaagcggatccgcagtggcgtgatttctggagaagtacctatgcatctgtcattccgggatggcatcagaataaagatcattggaataccattattctggatggtaccgttccggagcaggaaatccagcgtatgattgcggaaagctatgatctggttacggacagtccgaccagacggatttatgaagcggttaaaaaaattccgcgcggaaaagtggcaacatatggacaggttgcggagatggccggaaataaaaagatggcacgcgccgtgggaaatgcattgcataaaaatccggatccggagaagattccctgttatcgtgtggtgaacgcaaagggagaattagctggagaatttgcgtttggtggagaaggtgcgcaggcaaggctattgcaggcggatggaattgcagttgtcgatggacgtgttgatttaaaaatctatggtatataaatcgttgttttgctgcgtgttccgttcctcttgcaaaaatcaaaagcctcagaccatgccgtgaatcaccaatttagaaaaaattaagaaaattgttagcagacatgcttgacgagtgctaaaaacaatgctataacaaaactgaagcaaagatataagtacgtcttagtggaaaatgctctgactgagatggaatgacaggaagtgcattttagaaagcagttcctgtttttgtgattggtgaggtgataattatggcagcaaaaagagatttttacgaagttttgggaatagataaaaatgcagacgaagcaacgattaaaaaggcatatcgaaaacttgccaaaaaatatcatccggatatgaataaaggaaatccaaatgcggaaaagatttttcaggaagtaacggaagcttacgaagtgttaggagatccgaagaagcggaaattgtatgatgagtacggtccgatttcgctggaggcaggttttgatccggagaagatgaaacaggcacagtacgggaatccatttggaaatggaggattttatcagtcgtattcttccggagaaccgggcagcggatatcaggagttccattttgatggttcttccgatatggatgatattcttgacaaattgtttggaaaaaaaggtggattccacggaaccggaggttttggcggaagaagcggatttggaagtactggagaatttggcagtggttttggcggagtacatgaggaaagagggcaaaatatcgagacggaagtaccgatcagctttgaagaagcggtatttggctgtgataaaaggtttacgctttcttccagtgacggaaagagccagaactttgaagtgcatattccggcaggcattgcaaacgggcagtctgtgcgtctgaaagggaaaggacagaaagggtacaatggaaaggatggagatctgctgatcaaagtcaaagtcggagaaaaatctggttacgagcgaaaaggccaggatgtttatacgacggtgaaaattccgtatacaacagctgtgctcggaggagagataaagatccatacgttgtatggagatgttgtctgtaagattaaaccgggtacacagtctggggcaaaaatccgattgaaaggaaagggcgtagcagccatgaataatccggcagttcacggagatgaatatgcccaggtgcagatagaggttccgacacatttgtcgcagactgcaaaagaaaaattacaggaatatgcacgggcatgcagctgaatgtgaggttactgttcgcagggtaacctgtgaacagtaacatgtgagtgaatagtaacgatgaaataacagaagatcccttgacaagaggaactttccatgcttaaataaatttagttatatgactgacggataagtggaagaaccacgtggagtataacaagagatataaaggtgacagatccaaagattgcaccgcagatagggcgatacatcacagatgtaccgcagataaggcgatgcttcagagaagcaccgcaggggccgaccgtctgggcaccgcacattgcagggaaatacatgaaatatgtatttgattgaaatgtgggttcccggatgtgtcggtttttatttattttaggcgtatttgcgaaaggagaaacaaatgcagaaggtagcactcagtaaagaattaggcgcaacaacatatccgggacgtggtattgtgatcggacgttctaaggatggaaagaaggcggtaactgcttattttattatgggaagaagcgcaaacagccgtaatcgtgtatttgtagaggatggcgaaggtatccgtacacaggcatttgatccgtcaaagctggaagatccgagcctgatcatttacgcaccggttcgagtacttggcaacaagacgattgtgacaaacggagatcagaccgatacgatttatgagctgatggataagcagcagacatttgagcaggcgctgcgcaccagagaatttgagccggacgcaccaaattatactccacgtatttccggtatcatgcacattgataagggtgagttcaattatgcgatgtctatcttaaagagcaacaacggaaatccggatgcatgcaaccgttacacgtttgcatacagcaacccggttgccggagagggacattttatccatacttatatgggagacggaaatccactgccaagtttcgagggtgaaccaacctgggttgatattgatggagatatcgatacgtttacgaaaatggtatgggagaatttaaatgaggataataaagtttccctgtttgtacgttttattgacattgagactggaaactatgagtcaagaattgtaaacaagaataaataaaaataaataagagcggattgttgaaaaaggagaaaatcatgcaggaatatgaattaaaatacggatgtaacccaaatcagaaaccggccagaatctatatggcagatggcaaagaactgccgattaaggtgctctgcggaagagccggatatatcaattttctggatgcttttaatggatggcagctggtaaaggaattaaagaaggcaaccggacttccggcagcaacttctttcaaacatgtttccccggctggtgcagcggtaggacttccgctgtctgacgtggaaaagaaaatttactgggtcgatgatatggatattgagtttacaccgcttgcaaatgcttatatccgtgccagaggtgcagaccgtatgtcttcattcggagattttatttccctgtcagacatctgtgatgcagcaacagcaaaggtcatcaagcgcgaggtttccgatggtgtgattgctccgggatatacggaggaagccttggaaattttaaagcagaaaaagaagggcaattactgtgtaatcgagattgatccggcatacgagccggctccgatcgagcataaggatgtatttggtatcacattcgagcagggaagaaatgaacttcatatcggagatgatttctttgacaacatcgtgacagaaaacaaagaactgccagagcaggcaaagattgatctggcaatttccatgatcactttaaagtatacacagtctaactctgtatgttatgtcaagggcggacaggcaatcggtatcggagcaggacagcagtcccgtatccattgtacccgtctggctggttcgaaggcagataactggtggctgcgccagtctccacaggttttaggactgcagtttgttgacggtatcaagcgtgcggaccgtgacaatgccattgatctgtacatgggtgaggattatatggatgtccttgcagatggtgcatgggagaagatttttaaggtaaaaccggcggtatttaccgcagaagagaagcgtgcatggctggataaaaataccgatgtggcactgggatcggatgcattcttcccatttggcgacaatattgagcgcgcacacaaaagcggcgtaaagtatgtggcagagccgggcggatcggtacgtgatgacaatgtgatcgagacatgtaataaatacggtatggttatgagctttactggaatccgtttattccatcactaatttcaaagggacaggatacggacatgcggaatctgttcgtaggatcataaactctaaaatccaaacacaaaaacagccatttggaaatatccaaatggctgtttttgtgtttggatgatgaaaaataaatgaatttgcgcaaaatgtgggttctatatgcatgaaaaatatactaaaaaatacgaaaaatattgaaaattacacgaaacaaccgattgcgcaaatgaaaaagaatatgcttggaattgtgaaaagtgtgcaaaaaagaaagcgaaatatatcaaaattgtacattgacactgtgggactctcttgttatactagaatcatagaacaaccgattgcgcaaaagcgcagtccagaaataaaatacatctagcggagggagaacgagatggacaaatttattgtaaacatcatccatcgcccggagatggttccagagtattctgcaaccgtgaccggacagggaaaggaagaggatatcggagataaggctttacttacagagtctctcgatattttcaagacacagcagagactggcacatgagaatggcctgaaagttaccattcagatgacatacgcttctttgtttaacgatgaagcggttgagatcgcaaaacatgatcatgaagtctatggagatgaaatcgcactttcccttttgggactgccttgcgaagagttccgtgagaaatataagacaaaagatttctgtatctggatgttttccatggaggacaagaaggcaatcgttaatgatgtgttcgagaaattccatgatcgtttcggcttttatccggagtcaaccggttcctactatatggatgcagaactgatcaattatgtgaaggaagcttacccgtctgtgaagtgtgcggtagctacctgctgggaggaaggcccgaaagcatatcatacctgtaacaactcctggtatacacttttcgatggcggcccatgggcaccatggattccatccaagcagaatacacatgcgccggcagcaaatcaggcagaggacagtggaatcgtagctatcccacacctttcccgtgatctgattgcatgttatgacggaaacggatcaaacttcggtacacatccacagaacgtgcttcgcggtatgatttatgatacaaagacctgggagtatccgtatctgtataacctgatcgatcagtatcgtgatctggaaaaatacaacaatggatatgcttacaacatgatgttcgtcggaccaggctggatgaacaagatgggccgctgggaggctccatatgatctgctgttaaagtcatacagtgacggatgtaagtattacggagatttgaagaaagagggcaagctggtagatatgaccatgtccgagttcgcagatcactacagaaagaagaaaggcattaccgacgagaaacgttatacagagccggaatgtgccctttggagagatattttatacggatctgacaagcagctgttctggtactgcgatccgtttatgagagcctgtgttaatatggatcagggtggtgcgattgttgatcttcgtccatatgttgcaaaattaaactggccggttggtatcggaacacctcatgtacaggatgcttcttatccattcctgattcaggagaagtaccgtgccggatactttacacattacgcaggagaaggaacggtcagaagtgcaaagctctgctacaagggtgaggaagtagatctgtgcctctgcccgacacatgcacatttctcacaggaaggcaataccagaatcctgacactggacccggtaaccatcgagtttaacggactgacagtaaaattacagacaaaggaatattttgaggaaggttcttctaagatcaagatcgaaagaaatattctcgagatgagtgatccggatgcagaggttaccattgatgagtacatggtagcatgctacggaaccacagagtatccggaagatatgacatctgtcgtattaaaatgcgaaggtgcagatgaaaagaccattcactatgcatacaagtgccgcagtgaagtcctggcaggagcaaccgcagtcagcgctgtagtgcctccaatcgacaccaaagtttccctgactgcttcttctacagacgcagaaggatacattgaggaaggatatgcattctcaccaatgtttaaacttggatataagaagactattacagacaaggaggtatttgcaacatggctcaacttggaaaaggcaaattaaattacagatgtccgtcctgctttatgagagatctcgacatcgatatgttctacaataaagatacaaagatttacagttgtatccgctgccagtacagaggtacggaggaagacgttttagcgaaaaatgagatggttcgattccgttatggggcaatgcataagagattcgacaagtttgatttcgactaaaaagaacgtgcggtagctgccgcacgtttttaatatcagggtataactttcagggagtataatatgcctatgggacgaaaacaaaaagaaaccgtggaactgcgtttttatgaaattccacagggagaaccggtacttgctttgttgggagaggagtggaaccgggtatacggacatgacaatttttatctgcatttccataaccttatggagattggaatttgcagaaaaggcgaaggggagcttattataaatgaacacacgtatacctaccggacaaattctgtcactctgattcctccgaatattccacatacaacgatcagtaatggaatggttcggaattcctgggaatttttatatgtggatgtcaaccatgtcatggaggaactgtatggcgaccggatcgcacaaaaaaatgaggccattgaactggtacgcagatcggcacatttgctgcatggaagcgagtatccggagattgcagagatcgtcaatgccatcatccgggaagaaaaaaagcagagtccgtattatcgtcaggtgatcacaagttatctgcatgcgctggtgtatgagatgtttcgtctgaatgaagtacagacacagacgagacttgaggcggcaggaagcggaacaatgcggcagatcgcagatgcactcacgtttgtcaatgaccattatcaggaagaggtaaaagtgtgcacccttgcgcaggtctgtgggatgagtgagacatctttccggaaagtgtttgaagaatatgtgcatatgctgccgatggattatgtgaatctggtgcgtgtacaatacgcgtgtgaacagatgaaacatggcaatgattcaatggacgaagttgccagaaaggcaggattttccacaacttccacctttaaccggaattttaaaaaattttttaatacgtcgccataccagtggaagatcaatccacagcggtatgagcggaaattacagaactttcatattaacgcattaaagggatggtaaacgttttcgaagaaaaggagaaaagatgagcagatttattaaaggaatggacctttccacattgcttgagttagagcgctgtggggcaaaatattatgaccatggaaaagagcgggatattttagacatcatgagagattatgatgtggacacaatccgtctgcgtctgtggaatgacccgtattccgaaaccggtgaaccgtacggtgccggatgcaatgatctggcagagacaattgccatcggaaagaaagtatccgatgcgggattcggcgtattattaaattttcattacagtgatttctgggcagatccgggaaaacagattaagccaaaggcatggaaagattttgatgcggaccagctggaacaggcagtttatgagtttaccggggattctctgcgcaaagtactggaagccggtgtcaatgtgacaatgatccaggtgggcaacgaagtgaccaacggactgctctggccggagggattaaagccgaattatgacaatattgcaagatttataagttccggtatccgggcatgccgtgccataaaaccggagatcccgctgatgattcatctcgacaacggtggaaacaatgagatgtaccgcgactggttcgatcattatatggagcgtggggaagattttgattatatcggactttcctattacccgttctggcatggcaccctgcagatgcttgaagacaacatgaacgatatggtagcccgttacgggaaggaactgatcgtggcagaggtttctatgggatataccatggaagattacaagcagtatgagaaactaaaggacagtgagcgaaagggatatgcgacaaagccggaacttgtggcaaagatcgagtatccgatgacggtacagggacaggcagattttacgaaggacttcttaaaccgcgtggcacatgtgcgtgacaacaaaggtctgggatttttctggtgggagcctgcatggattccggtacacggaagcggctgggcaacgccggcatctttaaagtatatgaatgatccgggaccatgtggcaatgagtgggcaaatcaggcattgtttgactacgatggaaatgtccttccggcactggaagtgattcgtgattttagaaaataagatatgtaaaaatgttgcatgaaggaaggggaatgttgcaagttgcgcaaagcatattgcaaagaattcccctttatgtataatggaattatcaagaaaacgaaccgttgcaccaagcagcggatgaacatgcagaaagggagagaacaatgattcagaatgatgtattagcaaagtttaaagagatctttggcgatgagggggacatcagagtatattttgcaccgggacgtgtgaatctgatcggtgagcataccgattacaatggcggacacgtatttccatgtgcacttactattggaacatacatggcagcaagaaagagaaccgaccggaaactgtgtttttattccatgaacttcgatgagctgggtgtgatcgaaagttctctggatgcatttactccggacccggatggattgtggaccaactatccgatgggtgttatgtgggcatttgaaggacgtggcatgaaactggaaaccggtctggatattgcattattcggaaatattccaaacggttccggactttcttcttccgcatccttagaagtggttaccggatatatgttaaaggatctgtatggttttgatgtgaccaatcaggatctggctctgatcggacagtattccgagaacaattacaatggctgcaactgtggaattatggatcagtttgcatctgccatgggtaaaaaggacaatgcaattttccttgatacttcggatctttcttttgaatatgcaccaatcgtacttgacggggcaaaaattgtcgtcaccaacagtatggtaaaacacagcctggttacttctgcatacaatgaccgcagaaatgagagtgcacaggcactgaaggatctgcagaccgttgtggatatcaaaacgcttggagatctgacggatgagcagtttgagcagtacaagggagccattaaggatgaagttgccagaaagagaggcaaacatgcggtttacgagaatcagcgtacaatcgcagcagtcagggctctgagggaaaacgatattgaaacattcggaaaacttatgaatgcttcccatgtttccctgcgtgacgattatgagacctcctgtccggaagtggatgtacttgtggatgaagcatggaagattcctggtgtgatcggttcccgtatcaccggaggcggattcggtggatgcacggtcagtatcgtaaaggatgcatccgtggacgaattcaaggagaagctgacaaaggcatatgaggaaaaagtcggaaagacaccggaattttatgtggtttccatcggagatggcccaagccgtctgatttaagaacgtattacatagggtaaatgtgtgcggaactgattggaaccgcatttgccgacaggctttataaaaaggagtacgagatgattcaggagaacattttagagttagtaaaatatggtctgagcaccggactggtagatccggaggacaaagtatataccattaaccgcctgctggagctttttcaggtagacgaaatcgaggatgcggtatttgaaaaggtggaaaatcttccggcatggacacaggaagaggcagaaggaaaacttgagggaatccttgcagaaatgatggattatgcatatgagaatggcctcatggcagaaaacagtattgtatacaaagatttgtttgatacaaaaattatgggatgtctggtaccggaaccaagcagtgtccgcaagacgttccgtgatctgtatgagcatacctcaccgcttgccgcaacggattatttttacaaattaagctgtgacagcaattatatcagaagacagcgtatcaaaaaagaccgcaagtggacaaccgacaccgagtttggaacactggatatcaccatcaatctgtccaaaccggagaaagatccaaaagccattgcggcagcaaaaaatgcaaagcagagcgcgtatccgaagtgccagctctgtaaggaaaatgagggatatgcaggacgtgtcaaccatccggcacgccagaaccaccgcatcattccactgacgattaacaacagtgactggtttttccagtattctccatatgtatattacaatgagcactgcatcgtgttcaattccaagcatacgccaatgaaaatcgagcgtgcaacgtttggaaaacttctggattttgtgacacagtttccacattattttgtaggttccaatgcagacctgccgatcgttggaggttccatcttaagtcatgatcatttccagggtggacattatacatttgccatggcaaaagcaccgattgaaaaagaacttcagtttgagggattttccgatgtgaaagcaggaatcgtgaaatggccgatgtctgtcatccgtatcagcggaccggacaaggagcgtctgattgaactggcagacaagattctcttaacctggagaggctataccgatgaggatgcattcatctatgccgagacagatggagagccacacaatacgatcacaccgattgcacgcagacgtggagatgattttgaactggatctggtactgcgcaacaacatcacgaccgaggagcatccgctgggtgtctatcatccacatgcaaaactgcatcatatcaaaaaagagaacatcggtctcatcgaggttatgggacttgcggtactgcctgcccgcctgaaagatgagatggcagagcttgccgatgcactggtaaatggtacagacttacgtgcaacagaaacacttgcttcccatgcagaatgggcagaaggtttccttccgaagtatgataagatcacaaaagacaatgtgatggatattctgcatgaggaaatcggtctggtgttcaatgaagtgctgcaggatgccggcgtatataaatgtacaccggagggacgtaaggcattcgaacgttttattgcggctgtttaattgctttcttaggcagaggttacccattgagggagtgttttaaatataggttttctcaatgtgacggaagaaggcgtatattctctttctccagaaaaatttacaagtcagctctggcgttgatttcaggttctttgcgtaacattttttatattatgcaattagctttattcagtgagtgccagagcaagttgtaaatttattcttccgaaagaaatatacgccttcttcctgttggtttaggaaaagataatttgtaaaatatgctggtatctatacaaagaaaatttgtataaaagataccgttatggtatctatacacttaaaatgtaacatatcaatagatcacatttacagaatttgtgaaaatagttctttcacttatcttttttccaatcaacaggaagaagggggacatttctttcggaagaacaaatttgcaactgcgccgtagttccatcacataacgctaatggcattaaagtaaaatttttcaaaaaagaacctgaaatcaaaatcggcgctgctttgcaaatttttctggagaaagagaatgtcccccttcttccgtcgcatcaagaaaacttatatttatacctgttatttattggcaagcccccgcataagtttcttccggcaatgaaagaacgccggaagcaggaaacaatccgcaaacagccatgccagcggactggcaaaacatgcagccgtaaatccgaagatcggtacaaagatcagaccgatcaatgcgcgggcaatcatctcaaatacaccggcaaatacagcaaagccggaaaagcccattccctggataagaaaacgaacaatattgaccagcgacagaagcatataaaagcaggtgttggtgatcagaaattgtctggcctgtgcgacaacctgtgtgatattggcactgtccgaaggagctataaacagatagatcagtggacgtgcaaggaaaatgatgacaacaaggatcgctgcggagtaaactgcggcaagaatgatggcggatttcataccgcttgccagacgatcatattttccggcacccacgttttgtccaccgtaagttgccatcgtagaaccgagtgcgtcaaatgggcacaccataaacatcgaaatacggctgccggccgtcatggctgccacggcaccggaacctaaggtgttgacagcagtctgcagaatgacgcttccgatggcggtaatggaatactgcagacccataggaagtcccataatcagaagattccttacataggaagcatccagtacccagtcggagcgcttcagatgcagaatgtcaaatttccggatgatcacgaaaagacacagcacaccggaaaccgcctgcgataaaacggtagcaaatgcggcaccaaaaactccccagtgcagacagatgataaagaacagatccagtccgatatttaagacagccgcaacgatcagaaaaatgaccggcgtgatggagtcccccagagaacgcaggtaggaggagagtatattataaaggatggtggctggtatgccggcaaaaataacaacaatataattgtaggacaggtcgataatatcggaaggtgtctgcatcagcaccagaatctgccgacagaaaatgacggtcagtgccgtgagaacaccgccgatgagaaccgacagaatggcggaattaccgacatatttgcgcacaccgtcatagtcgcgcgcaccgaaccgctgggcaaccggcagaccgaaaccgttgcagattccctgacagaatcctatgatcagaaaattgatacttccggttgccccaactgcagcaagtgccgttacgccgagatagcggccgacgatgatggtgtccatgagactgtaaaactgttgaaacagcataccgaacagaagcggtacggcgaaaccgagaatcagtttcataggggaaccgctggtcaattcttttgttgtacttcttgccataatgatttactccttttatattttaaacaaaactgcaaatgctaggatattttatcacgattgtgtaaaactacaagaggaaaaaatgctgaaatttcattttttttgcgttttttttgccgcgtcaattctttacatttgaggaagaatgcggtagagtggtaagtgactgtaatattgtacatataaaggagattaaagttgaaaaactgggaaaaaaatatacgtaaggttgttccctatacaccgggagagcagccaaagaaatcacagatcatcaagttaaataccaatgaaaatccatatccgccggcaccgggggtaaaggaagcattggcacattttcatacggatgatctgcggctgtatccggatccggttgtgacggatctggtggatgggattgcacaattctatcaggtagacccttcgcaggtctttgtcggtgtcgggtcggatgatgtgcttgcaatgctgtttatgaccttctttaattcaaagaagccgattctgtttccggatattacctattccttttatgacgtgtgggcagaaatgcttcgcattccgtatacacagattccgctggatgatgcattccgcctgaatccttcagactataaatgtgaaaatggtggaattgtattcccaaatccgaatgcgccgaccggggaacttcttccggtatctgccatcgaggagatcattcaggcaaatccggatgtgattgtgatcgtggatgaggcatatattgactttggaggagagagtgccctgcctctgattgataaatacgataatgtaattgtggtacagacattttccaagtcacgttctctggcggggtcgaggattggctttgccatcagtaatccgacactgattaaatatttaaatgatgtgaagtattccttcaattcatacacgatggatcgtatcaccattgctttgggaacggcatctatccgtgaccgggcatattttgagcagacgacagagaaaatcataaagacaagagagtggaccaaagagcagcttcgggcactcgggttcgtatttggtgattccaaaagcaactttatttttgccatgcatccggatgtttccggtgtggaactgtttgaagcactgaagaaaaatgatatttatgtgcggcattttggcaagccggcacggatcaacgaatatctgcgtatcacaatcggtacggatgagcagatgcataaactgatcgattttctgaaaaaatatttaaataaataaagcgaggattttttatgttgacaaaatacttgtgggtattttttgtttccatggtaccactggtggaactgcgcggttccattattatttcgcagggactgcagctgccggtactttcttcttatattgtggcaattatcggaaatatgctgccggtgccggtgatttatctgtttgcacggaaagttctggtatggggagcggataaaccggtgattggaaagtttttttcctggtgtctggagaagggagaaaagggcggaaagaaattacaggaaaaagcaggccgggggttgtttatcgcactgctcctgtttgtaggaattccgcttccgggaaccggtgcatggacaggaacactggcggccagtattctggacatggattttaaatcaacaattatcgccgtcatgctcggggttctgctggcaggaattattatgatggtgctcagtgtggcaggattcggcatgtttttgaaataaccaaggaagtaattaatcaatgaaagacaagaaaaaaaccaagacgattccgcgtcaggtgcgctgggataagcttgataatacagcacatcttttcccgtccattgcgggggagagtatgacaaacgtgtaccggatcagtgtgaccttaaaagaagaggttcaggtggaatttctgcagcgggcgctggacatgattctgccgaaattcgatgggtttaatcttcggatgcgcacaggcgtattctggtattattttgaagagaacggaaaaaaggcgccgaaagtcacggaagaggcgatgtttccatgccggtttatccggcagaacaaaaaccgcaattatctgttccgtgtgacctattataagtcaagaatcaatctcgaagtgtttcatgtactgaccgatggcatgggaggcattaatttcctccgggagctgacgtatcagtatctgcgtctggtgcatccggaactggcggaaaaagaaggaaacaaactgagcggagatacctctctcagcagggaggacagctttgtccgcaattaccgcagcagcaagccaagcggatttaataaagaaaaagcatatctgatcaaagaagataaacttccggccggagaatttggtgtcatgcatgggcggatgccggtctcacagctgaaaaaggtagcacatggctatcatgcatctttgaatgaatattttattgcagtctttgtatggagtgtgtataaagaactgttacacgggatgccgggaggaaaaccgatccgaatcgcagtgccggtcaatctgcggccgtattttgattcggatacgacaaaaaacttttttgttatggtatctgcagaattccgtccacagaaagagtcctacacgtttgaggaagtacttgcatgcatacaaagcagcctgcactcccagatcaataaggaacatttagaggatctgttttcttacagtgtatccaatcagaggaacctgcttatgcgtccggtgccgctatttttgaaaaatattgccatgcgtatcgtatatgaaaaatccgcagtggcaaatacgacaacgatcacaaacatcggtaatatcaagatcaaagatatttaccagccctatatagaaggtttttcggcttttatagccatgtcaaaagggcagtatctgaaaggaacgatctgttcttaccaggatacgctggtatttacattcagttccatcttttccgaggctctggtacagaaggcatttttccgcaagattgcggcggatggtgtggatgtggagattgagacgaacggagtatattatgaataaatgcaaaaaatgtaatgttgtcatattggacgatacggaccgctgtccgctctgtaaacatgtgctggagtcggacgggataccgggagagagccggtatccggatgccattgcaacggcgcgtaaattccggtttgtggagaatctggtactgtttatctccattgtggcggagtgtctgctgattgccatcaattttcatgtggacagggaagtggcatggagccttgtaattggtatcattcttttatatggaaatgtggtgcttcgcatggcaattctgggaaaatccggatatctggccaaaaccgtctgtctggtacttcttgccattgtaatgcttcttggaattgattatctgaccggataccggcgctggtcgttagactatgtgcttccggggggaatcattgccattgatctggcgttgtttatcctgattctgataaaccggagaaactggcagagttatatgatgtcggaactgctgacgatattgctgagcattgtgccggtggtattgctgcagatgagaatcattcattttccatatctggcatgggggtccctcggggtatcggtatttttattccttggaacactgattcttggtgatcagcgtgcacgaaccgaactgaaacggagatttcatatatgatagaaagcgaagcgagtgtaaaaggacgtgtggtggcagaaatgctgtcacattttaccaatgatttgaaaatcggaaaaaaaataaagagcggagagctgcgcaagcggatgatagagccgccatggattccaccggcaatgtttaacctgacgggaatcaatatggatcattttacgatgaaacttttgtcgttaaaggaaaatccaaacacggattacgtgattctgcagttacacggcggtggttatacgggagctgtgcgcaatgcgtattatgtgtttgcaggattatataacgagctgagccatggatgcaatgtgcttactccggattatcgtgtggccccggagaatccatatccggcggcacttgaagatgcattggcatcataccgctggctgctttccaagggatattatggagaacagattatccttgccggagattcggcaggcggtggactggcgatggcactctgtatgtatctgcgggatcataatatgccggtaccgggaggaatcatagccatgtctccgtggacggatctgacggccagcggggagtcttatgagaccaattatgagaaagatccactgtttggaaatacgaaggagagtctgatttaccagaatgattatccgggggaacatgaccggatggacccgtatatttctccgctgtttggggatttccggggatttccgccaatgctcatacaggttggatcgattgagatgcttctgagtgattcggtttcggtagcggcaaaggcaagggagcagggggtaaaagtgcgcctgtctgtttatgaagggatgtttcatgtgttccagatggcatatctgaatattccagaatcaaagaaggcatgggcagaagccggcaaattcattgatgtgctgcgcacggacagcagactgtaaaaattattacaaaaatggcgcggaattttttcacatattgcataaacgcctagatacgtctacatttccatggagtaagcctccacatgatgtagaaatatgggttgacaataacacaagatgtagtgtagtcttgtatttgttaatgaaaatatacaagatatagggagtaatctctatatcttatattttgtgtaaacaatcgtttataaagatagactttgagaggaagatggaacatgaaaattattaagagaagcggagtcgaggtattttttgattcgaataagatcgttgcggctgtacagaaagcgaatgcatcggtaatcgattatgaaaaactcagcgatgagcagattcaggagattgccgataatgtggaagtggcatgtgaaaacatgaaacggtctgccagcgtggaggaaatccaggatatggtagagaaccagctgatgaaccagcatgcatttacggttgcccgtaattatattacataccgttataagagagcgcttgtgcgtaaatccaattctacggatgaacagattctgtccctcttagagtgtaacaatgaggaagtaaaacaggaaaattccaataaaaatcctactgtaaacagtgtacagagagattatatggcgggagaagtcagcaaggatatcacgaagagattcctgttgccggaagatattgtggaagcacatgaaaaaggactgattcatttccatgatgcagattattttgcgcagcacatgcataactgctgtctggtgaacttagaggacatgctgcagaatggtactgtaatcagcgagaccggaattgaccgtccgagaagtttttccacggcctgcaatatagcaacacaggcgattgcgcagattgcaagttcgcagtatggaggacagagtatttcactgtcccatctggcaccgttcgtacaggtgagccgtgaaaaattccggatacaggtccggacagagtttgaaaagatcgggctggatctggatgaggagaaaatcaataaagtagcagagatgcgtgtaagagaagagatcaaccgtggtgtgcagatgatccagtatcaggtgatcacgcttatgaccacaaacggtcaggctccgtttatcacggtgtttatgtatctcgacgaagtgccggagggacagaccagagatgacctggcagcgatcattgaggagatgctgcatcagagaatcaagggagtaaagaacgaaaaaggagtatttattaccccggctttcccgaaactgatttatgtactcgaagaagataatatccatgaggattccaagtatttttatctgacacgcctggctgcacagtgtacggcaaagcgcatggttccggattatatttccgaaaagaagatgaaagaactgaaagtggacaagaacggggaaggacactgctatccatgtatgggatgccgcagttttcttactccgtatattgacccggaaaccggaaaaccgaaatattacggacgttttaaccagggagttgtgacgatcaatctggtggatgtggcatgttcttccggaaaagatgagaaaaaattctggaagattctcgatgagcgtctaaaactgtgctaccgggcactgatgtgcagacataagagacttcttggcacaccgagtgatgtggctccgattctgtggcagaacggagcgcttgcccgtctgaaaaagggagagacgatcgacaaacttttatttggcggttattccaccatctctttgggatatgcgggattgtgcgagtgtacccgttatatgacaggtgtttcccatacggagccggagaccggaacaccatttgcactgcgtgtcatgcagcgtctgaatgatgcctgtgcagagtggaaagaaaaggaaaatatggatttcagtctgtacggtacgccgctggaatccaccacctataaatttgcaaagtgtctgcagaagcgtttcggtatcatagagggcgtaacagataaaaattatattacgaacagttatcatgtgcatgtgacggaaaatatcaatgcttttgataaactgaagtttgagtcacagttccagaagctgtctccgggtggtgcaatcagctatgtggaagtaccaaatatgcaggataatattgatgccgtgattgccgtcatgaaatacatttacgataatattatgtacgcggagctcaacacgaagagtgattactgtatggaatgtggctatgacggtgagatcaaaattgttgaggaaaaggacagcggaaaactcgtctgggagtgtccgaactgcggaaaccgtgatcaggataagatgagtgttgcacgtcgtacgtgcgggtatatcggaacacagttctggaatcagggacgtacacaggaaatcaaagaaagagtattacatttataaaacatggaagaaaacaaacggaaacaatatgcccatttgtatgaacaccatgaggtagaagatccacaaccccgggaagaaaaagaaaaacccatcgggccgagtggcagaaaccgccatcggccgatggtggaaaaggtatgcagacgcatcgccttttctttcctggccatggcggttgttctgttacttgcattgaattattttcagatcaaagaggcaaaaaaggaagcggttttggaatatatccgcaaagaaaagcagcaaatgaaaaatcgtgagacagaaaagacggaccagcttgcaatcttagaccaatatgatatattatatagtatgtatccggatctggttggatggatcaaagttgacgggacaccaatcgattatccggtgatgcaggatcatacaggcggggaatattatctgaaacacaattttgaaggaaaagatgataataagggaaacccgtttgtttccgcagatgccagcattgatccgatggatcagaatattgtgatctttgggcacaacgtaagtgatggaagccagtttggagatctggatgcctatctggataagaaattttacaaaaagcatccggtgattacttttgatacgatttatgaaactggacaatatcagattgttgcggtggtaaagacacatgtaaaggaaaaagacgaatccggattccgttattactggtttcggaattataaaaaccggaaagagtttcagaatctgctggattttgtggaagagaaccgtgtgtatgatacaggggagcatcttatctatggagataccacaatcatgctctctacctgtgaatacacggtaaacaatgggagactcgtagtcatagcaaaaaggatatagggcagaagatgaaaaaattagggatgatgaaaacgatactgatgatgggatgtgcgctggcgctgctttttgcagccgttccgcagccggttatggcagcgaacagccagatgaatctgacggttggaacaaccaatgatgcaaaagccggagatacggtaacggtgcgtctggtcggaagcaataatccgggactttcgacatttgcagcaagactggcatatgacgattctgatctggaatatgtaggaaccacatgggcaaatacgatttcttcggattcgggaaatattgagctggtttccccggttacggaaaataatcagcaggcacttaatctttcggcaattttaaataagacttattcccagaatgaaaccattgccacggttacctttaaggcgaaaaatgcatatacaacgatgccagttaccctgacagtgcgtgaagtgacggatgcaagttacaatccggttacggttacaacggttgtggatgcttctgcaggacagacacagagccagtcacagtcccagagcacttcccagagtcagtcggacagtcaggatgacacagagtatacagatgatatagacgatacggacgataccgattcgtacgatgatacagacgatacgcaggattcccagagcagcagcgggaatacacataaaacttcatcgaacaaaaagaataacagtggaaatacatcaaaaaacggaaaccggacagatgcaacaccaaagacaggagcggttgatctgcggatggtatttggagcagcagtaattgtttttttactggcagcagcaggctgcatccgtttcctgaataaaaagaaagagtaaattatgaattatgctggaattaagtattgtgacatcgcaaacggtctcggctgtcggacggtactgtttgtatccggatgccgcaatgcatgtaagggctgttttcagccacagacatgggattttacctatggagaatgtttcgatgagcaggtacagcaaaaggtgcttgattcactgaaaccggagtatatagagggaatgaccctgttgggaggagagccgtttgaggaagaaaatcaggaggctcttcttccttttatgaaaaaagtaaaaagtttgtatccggataagaatgtctgggcatttaccggatatatatatgataaagacctgattttgggaggcagaaaacatacgaaagacacggatgacctgctttccctgatcgatgtacttgtggacggtccatttattgaggaacagaaggatattacgctcaagttccggggatcggtcaatcagcgcattcttgacttgaaaaaaaccatggaaagtggcaaaatagttaagttgatggaatagttatgaaaacgaggatggatacatatgaaaaagcatattaatgcattgttgggatttgtctgttatacaatcggtgtgattgcagcagcatattacgggttgtggaagatgcttgtgcttccgcttcatactctggcagtttcttttctggcaggggacctgaatgtcacactgcttgcggtatgtgttgtcaaaatacttttttcaacaacgatggcaggattgatctggtgcattggctatatagcctataatcactttaaaggcacacaggatccggactgggaaactatggagaaagagtacatggcagaaaaagaagagaaagagaggcaggcatcgtgattttacgggttccggaatattatgagaaattttcctgcattgcatcccgctgcaaggacagttgctgtgcaggctgggaaattgacattgatgaggattcctatgcatattacaacagtgtggaaggcaaatttggcaaaagactcaaagaaagtatgtatgaggccgatccggatgatgatggcggtggataccgttttaagctgaaagggaagaaacgctgtgccatgctcaatgatcataatctctgtgatctttatacagcacttggggaagaggctctgtgtgaagtgtgtacagaatatccgcgtttttccctgatttacggagatgtggagcagaaagcactgagtctttcctgcgaggaagtcggacggattctgtttgagcggacagaaccggaaaagctggtggatatagagctgcccggaaattgcgatgacggtgaggacgatccggcatatgttgcattcatggaatgggtgcagcaggagtcggtgaatattctgcagaatcgtacccataatattccggagcgcatgagagagtttctggcgtggtgtgaccgtgtacagaccgtgatcaattatgcacaggcaaaagaggatatgtcggtactggcagactggagatacgaagatgccggtcatgaacttcgggagtgggagcagaaaaatattgagggaaaagagaagccggttcgtgcactttcttatgaagattttgaggaacgttttgcggtttttgccgatatggaagagctggatgaggaatgggttcacaccaaggaagaattcgaaaagctgtatcacaaagatacctatgaggcatttctgacagaatatatgcgatcatcggattattcggaacttggctatgaacatcttctggtttattttgtgtatcgttatctgatgaattcgatatatgattatgatattttatcctatgccaaaatgatcgtgatggcaacccttgtggtacgagatatggatgcggcacgtttttacagaaacggtggcaaattcacaatgtctgaccgtattgatgtagcgcgtattttctcaaaggaagtggaacattccgaaggaaatgcacaggatctgaaagaaatgtgtatgatggaagaaattgcgaaagtggatgcactttgcagacagatttaaacgtttataacagagataaaacaggcatctggcgaaccccggatgcctgttttgtattatgctttatttgtctaacagatcggtatagaaatctgcgtaatccttgcggttgtccttgcaaaaatcaatggcagcagatggatgctggttcagacgtccggtcagcagatacggaatatcatatccccatacggcaccggtttctttgagcggcagcatatagtcttctaagaaccggagtaccgggaatacattgtatttcggatttttcagaaaactcagaagcagtt

(The sequence listing continues in the following parts.)

(d) trehalose at about 5% to about 20%, sodium glutamate at about 3% to about 15%, ascorbic acid at about 0.01% to about 2%, and maltodextrin at about 2% to about 18%.

8. The composition of claim 3, wherein the cryoprotectant comprises
   (a) sucrose at about 17.8%, propyl gallate at about 0.2%, sodium caseinate at about 6.4%, and sodium citrate at about 0.6%;
   (b) sucrose at about 17.5%, sorbitol at about 0.9%, sodium glutamate at about 8.5%, and sodium citrate at about 0.6%;
   (c) trehalose at about 15%, sodium glutamate at about 8.5%, and cysteine at about 0.1%; or
   (d) trehalose at about 10%, sodium glutamate at about 8.5%, ascorbic acid at about 0.2%, and maltodextrin at about 10%.

9. The composition of claim 6, wherein the bacteria, when tested for survival upon lyophilization in the cryoprotectant, survive with less than about a 1 log unit reduction in CFU of viable bacteria over about 12 months after lyophilization in the cryoprotectant.

10. The composition of claim 1, wherein the composition comprises from about 1×E3 to about 1×E11 colony-forming units (CFU) of the SCFA-producing bacteria and mixtures thereof.

11. The composition of claim 1, wherein the bacteria and/or mixtures thereof produce at least about 1000 micromoles of the SCFA over about 24 hours.

12. The composition of claim 1, wherein the SCFA is acetate, propionate, or butyrate, or a combination thereof.

13. The composition of claim 1, wherein the composition further comprises a prebiotic.

14. The composition of claim 1, wherein the composition further comprises at least one additional bacteria that degrades resistant starch.

15. The composition of claim 14, wherein the bacteria that degrades resistant starch is *Bifidobacterium adolescentis, Ruminococcus bromii, Bacteroides thetaiotamicron, Bacteroides ovatus, Bifidobacterium breve*, or *Roseburia intestinalis*.

16. A method of increasing short chain fatty acid (SCFA) in the gastrointestinal tract of a subject comprising administering to the subject an effective amount of the composition of claim 1.

17. The method of claim 16, wherein the SCFA is acetate, propionate, or butyrate, or a combination thereof.

18. A method for reducing or maintaining glucose level and/or body weight in a subject in need thereof comprising administering to the subject an effective amount of the composition of claim 1.

19. The method of claim 18, wherein the subject suffers from diabetes or pre-diabetes.

20. The method of claim 13, wherein the prebiotic comprises a resistant starch.

* * * * *